(12) United States Patent
Kozlowski

(10) Patent No.: US 9,808,512 B2
(45) Date of Patent: Nov. 7, 2017

(54) ANTI-CELL PROLIFERATIVE COMPOUNDS AND METHODS OF USE

(75) Inventor: Michael Kozlowski, San Diego, CA (US)

(73) Assignee: KALOS Therapeutics, San Diego, CA (US)

( * ) Notice: Subject to any disclaimer, the term of this patent is extended or adjusted under 35 U.S.C. 154(b) by 672 days.

(21) Appl. No.: 12/345,023

(22) Filed: Dec. 29, 2008

(65) Prior Publication Data

US 2009/0238817 A1 Sep. 24, 2009

Related U.S. Application Data

(60) Provisional application No. 61/009,382, filed on Dec. 28, 2007.

(51) Int. Cl.
| | |
|---|---|
| *C07K 7/06* | (2006.01) |
| *C07K 7/08* | (2006.01) |
| *A61K 38/00* | (2006.01) |
| *A61K 38/22* | (2006.01) |

(52) U.S. Cl.
CPC .............................. *A61K 38/2242* (2013.01)

(58) Field of Classification Search
USPC ..... 424/130.1; 514/1.1, 12.4, 19.3; 530/328, 530/326
See application file for complete search history.

(56) References Cited

U.S. PATENT DOCUMENTS

| | | | |
|---|---|---|---|
| 5,208,218 A | 5/1993 | Van Snick | |
| 6,376,257 B1 | 4/2002 | Persechini | |
| 2003/0203373 A1 | 10/2003 | Schleuning | |
| 2004/0016004 A1* | 1/2004 | Raitano et al. | 800/6 |
| 2005/0209139 A1 | 9/2005 | Vesely | |
| 2005/0272650 A1* | 12/2005 | Mohapatra | 514/12 |
| 2006/0276382 A1 | 12/2006 | Mohapatra | |

FOREIGN PATENT DOCUMENTS

| | | |
|---|---|---|
| JP | 2005-525107 A | 8/2005 |
| WO | 01/92549 A2 | 12/2001 |
| WO | 01/92549 A3 | 12/2001 |
| WO | 2004/083236 A2 | 9/2004 |
| WO | 2004/083236 A3 | 9/2004 |
| WO | 2005/094420 A2 | 10/2005 |

OTHER PUBLICATIONS

Vesely et al. (European Journal of Clinical Investigation, 2004, 34:674-682).*
Burgess et al. (J. Cell Biol. 111:2129-2138, 1990).*
Lazar et al. (Mol. Cell Biol. 8:1247-1252, 1998).*
Wen et al. (Proc. Natl. Acad. Sci. U.S.A. 98: 4622-4627, 2001).*
Berg et al. (Biochemistry 5th ed. New York, WH Freeman, 2002, Section 3.1.).*
Eichelbaum, E.J., et al., Cardiac and Kidney Hormones Cure up to 86% of Human Small-Cell Lung Cancers in Mice, European Journal of Clinical Investigation, 2008, 38, 562-570.
Kong, Xiaoyuan, et al., Natriuretic Peptide Receptor a as a Novel Anticancer Target, Cancer Res. 2008; 68:(1), 249-256.
Baldini, P.M. et al., Decrease of Polyamine Levels and Enhancements of Transglutaminase Activity in Selective Reduction of B16-F10 Melanoma Cell Proliferation Induced by Atrial Natriuretic Peptide, Melanoma Res., 2006, 16:501-507.
LeLievre, V. et al. Proliferative Actions of Natriuretic Peptides on Neuroblastoma Cells, The Journal of Biological Chemistry, 2001, 276(47):43668-43676.
Ohsaki, Y. et al., Human Small Cell Lung Cancer Cell Lines Express Functional Atrial Natriuretic Peptide Receptors, 1993, Cancer Res. 53:3165-3171.
Rashed, H.M. et al., Atrial Natriuretic Peptide Inhibits Growth of Hepatoblastoma (HEP G2) Cells by Means of Activation of Clearance Receptors, Hepatology, 1993, 17:677-684.
Ala-Kopsala et al: "Molecular Heterogeneity Has a Major Impact on the Measurement of Circulating N-Terminal Fragments of A- and B-Type Natriuretic Peptides" Clinical Chemistry, vol. 50, 2004, pp. 1576-1588, XP002527980.
Communication Pursuant to Article 94(3) EPC dated Jan. 31, 2012 for European Patent Application No. 078868377.6.
Sun, Y., et al., Atrial Natriuretic Peptide and Long Acting Natriuretic Peptide Inhibit MEK 1/2 Activation in Human Prostate Cancer Cells, Anticancer Research, 2007, 27:3813-3818.
Vesely, D.L., Atrial Natriuretic Peptides: Anticancer Agents, Journal of Investigative Medicine, 2005, 53(7):360-365.
Calabrese, E.J, et al., U-Shaped Dose-Responses in Biology, Toxicology, and Public Health, Annu. Rev. Public Health, 2001, 22:15-33.
Vesely, B.A., et al., Four Peptide Hormones' Specific Decrease (up to 97%) of Human Prostate Carcinoma Cells, European Journal of Clinical Investigation, 2005, 35:700-710.
Sun, Y., et al., Vessel Dilator and Kaliuretic Peptide Inhibit MEK 1/2 Activation in Human Prostate Cancer Cells, 2007, 27:1387-1392.
Japanese Patent Application No. 2014-264700, Non-Final Office Action mailed Jan. 5, 2016.

\* cited by examiner

*Primary Examiner* — Yan Xiao
(74) *Attorney, Agent, or Firm* — Pillsbury Winthrop Shaw Pittmann LLP

(57) ABSTRACT

The invention provides compounds such as proteins, peptides, peptidomimetics and small molecules, methods for treating cell proliferative disorders such as neoplasia, tumor, or cancer, and metastasis thereof, and methods for identifying and screening for active compounds.

12 Claims, 2 Drawing Sheets

ANTI-CELL PROLIFERATIVE COMPOUNDS AND METHODS OF USE

RELATED APPLICATION

This application claims priority to U.S. Application Ser. No. 61/009,382, filed Dec. 28, 2007, which is expressly incorporated herein by reference in its entirety.

FIELD OF THE INVENTION

The invention relates to conserved anti-cell proliferative (e.g., anticancer) motifs in proteins, peptides, and peptidomimetics, and methods for treating cancer and medicaments using the described motif.

INTRODUCTION

It has long been observed that naturally occurring peptides, certain medicines, and natural substances have more than one observed activity. For example, many medicines have side effects, which can appear entirely unrelated and sometimes deleterious to the primary intended effect of drug. However, not all such side effects are deleterious to the health of a patient being dosed with such drugs.

In certain instances, the side effect may be so useful as to provide entirely new applications to the drug or naturally occurring substance. Examples of these include finasteride (Propecia), used as a treatment in benign prostatic hyperplasia (BPH) and prostate cancer in higher doses, which is registered in many countries for male-pattern baldness. Another example is sildenafil citrate (Viagra), now famous in the marketplace for its side effect, rather than the originally intended application thereof.

In some cases, observations of an effect of naturally occurring substance indicates a possibility that such substances may have some new utility, but the primary observed effect of that substance may overwhelm any observed "new activity" in vivo. As a result such observations remain in vitro, or ex vivo curiosities, since the desired new activity effect is merely a side effect of the active substance.

One example of such an observation is the finding that the Natriuretic Peptides (NPs), which include ANP, BNP, CNP, and urodilatin, in humans, have many biological activities in addition to their primary, cardiovascular effects (e.g. the regulation of blood volume, blood pressure, and cardiac function), which include metabolic effects (e.g. control of fat metabolism) and cell growth modulating (e.g. antiproliferative) effects [Potter, et al. Endocrine Rev. 27:47 (2006) and references therein; Vesely, D. L., Curr Heart Fail Rep. 4(3):147 (2007).

Recently, it has been demonstrated that certain NPs also have the ability to kill cancer cells or to attenuate their growth both in culture and in animal models of human cancer [Baldini, et al, Cell Death Diff., 11:S210-S212 (2004); Baldini, et al, Melanoma Res. 16:501-507 (2006); Lelievre, et al., J. Biol. Chem., 276(47):43668, (2001); Levin, et al., Am. J. Physiol. 30:R453-R457 (1991); Vesely, D. L., Eur J Clin Invest 38(8):562 (2008).

While each of these effect may beneficial in their own right, sorting the milieu of effects from the NPs may hinder development of a safe and effective therapy for any one specific area targeted for treatment. For example, a large change in blood pressure accompanying dosing of an antiproliferative may frustrate the exercise of treating the patient at all, by creating one serous complication while treating another problem. As a result it is essential to sort out the structure, motif or action which is responsible for one function and separate it from others if possible.

Investigators have noted that NP's share common structural features which are thought to contribute to both their receptor binding characteristics and biological activities [He, X-L. et al, Science 293:1657 (2001); Moffatt, et al, J. Biol. Chem. 282(50):36454 (2007); Potter et al. Endocrine Rev. 27:47 (2006)]. These include a ring structure and a shared amino acid sequence, or motif. Different versions of this motif which have been proposed include CFGXXXDRIXXXXGLGC [Potter, et al., Endocrine Rev. 27:47 (2006)] and CFGXXXDRIXXXXGLGCS [He, et al, Science 293:1657 (2001)]. In each case, the two C residues are connected by a disulfide bridge. An NP motif consisting of FGXX(L/M)DRI(G/S) has also been proposed [Moffatt, et al, J. Biol. Chem. 282(50):36454 (2007)]. This motif is also found in other endogenous peptides, such as osteocrine and musclin (with replacement of the I residue with an L residue in the latter case), which share some of the metabolic and cell growth modulating effects of the NP's but lack their cardiovascular effects [Moffatt, et al, J. Biol. Chem. 282 (50):36454 (2007); Nishizawa, H., et al., J. Biol. Chem. 279:19391 (2004); Potter, et al., Endocrine Rev. 27:47 (2006) and references therein]. This motif has been termed the Natriuretic Peptide Motif (NM) [Moffatt, et al., J. Biol. Chem. 282(50):36454 (2007)]. The ring structure of NP's appears necessary for binding to NPRA and NPRB, and for cardiovascular activity [Collinson, P. O., Bus. Brief. Eur. Cardiol, 66 (2005) and references therein; Potter, et al. Endocrine Rev. 27:47 (2006)], and the R14 residue (numbered according to ANP), which is an element of all proposed motifs, is believed to be necessary for binding to NPRC [He, et al, Science 293:1657 (2001); Lanctot, et al, Patent US2007/0049251 A1; Moffatt, et al, J. Biol. Chem. 282(50):36454 (2007)].

It would be beneficial to define a specific motif, which would reliably predict anticancer efficacy, and provide a therapy for treatment. Such a motif would provide not only a peptide, but peptidomemetics, and small molecules which would be useful as medicaments.

In the case of the NPs, three specific types of NP receptors (NPR) are believed to mediate the actions of NPs. The A-type receptor (NPRA) and the B-type receptor (NPRB) are thought to be involved in NP signaling since they have integral guanylyl cyclase domains [Potter, et al., Endocrine Rev. 27:47 (2006) and references therein]. The C-type receptor (NPRC), which has no guanylyl cyclase domain, is thought to be primarily a clearance receptor (i.e. deactivating NP's by reuptake) but it has also been suggested that it is linked to several intracellular signaling pathways [Gower, et al., Mol. Cell. Biochem, 293:103 (2006); Hashim et al. Am. J. Heart Cir. Physiol, 291:H3144-H3153 (2006); Lelievre, et al., J. Biol. Chem, 276(47):43668 (2001); Panayiotou et al. Proc. Brit. Pharm. Soc, 41:abs 009P (2005); Prins, et al, J. Bio. Chem. 271:14156 (1996); Segawa, et al., Naun.-Schmeid. Arch. Pharmacol. 357:70 (1998)].

Each of the NPs appear to interact with these NP receptors, though their affinities each differ for NPRA, NPRB and NPRC. It has been speculated that the relative anticancer potencies of NP's are related to their binding affinities at NPRs [Vesely, D. L., Eur J Clin Invest 38(8):562 (2008) and references therein].

The prior art failed to recognize the role of NPRC in prediction of anticancer activity. In fact, though the art did observe that anticancer potency observed for ANP is greater than CNP [Vesely, D. L. Eur J Clin Invest 38(8):562 (2008), and references therein], in agreement with their activities at NPRC, the role of NPRC was clearly not recognized since NP related peptides (VDL, LANP, KP) were rationalized as not acting at NPRC, but at non-NP receptors [Vesely, D. L. et al., Peptides 11:193 (1991)].

Possibly because the investigators linking NPRC activation and cancer have disparate areas of expertise, the relationship of how these observations relate to the treatment of cancer has not yet been clearly understood or appreciated. Had any predictive value been assigned by the prior art, it is possible that drugs related to any such prediction would have been tested.

In fact, antiproliferative effects have been surprisingly found in NP analogs and peptidomimetics modeled after them that tend to exhibit NPRC-specific activity. Other known molecules [Baldini, et al, Cell Death Diff., 11:S210-S212 (2004); Baldini, et al, Melanoma Res. 16:501 (2006); Gower, et al., Mol. Cell. Biochem, 293:103 (2006); Lelievre, et al., J. Biol. Chem, 276(47):43668 (2001); Levin E. R. and Frank, H. J. L., Am. J. Physiol. 30:R453-R457 (1991)] correlate well with this discovery. Moreover, NPRC stimulation modulates the MAP kinase (MAPK) pathway [Hashim, S., Li, Y, Anand-Srivastava, M. B., Am. J. Heart Cir. Physiol, 291:H3144-H3153 (2006); Lelievre, et al., J. Biol. Chem, 276(47):43668 (2001)]. Other types of MAPK inhibitors have been found to possess anticancer activity [Dhillon, et al., Oncogen 26:3279 (2007) and references therein].

Without resorting to mechanistic rationales for why this might be the case, the inventor has discovered that the NPRC related interactions with the motif described herein may influence or modulate the MAPK pathway which may have an effect on hyperproliferative diseases [Hashim, S., Li, Y, Anand-Srivastava, M. B., Am. J. Heart Cir. Physiol, 291:H3144-H3153 (2006); Lelievre, et al., J. Biol. Chem, 276(47):43668 (2001)]. This invention shows the involvement of NPRC in the anticancer effects of NPs, analogues and other unrelated peptides fitting the anticancer motif. The antiproliferative effects of NPs observed in both normal and cancer cells can also be produced by NPRC-selective NP analogs and peptidomimetics [Baldini, et al, Cell Death Diff., 11:S210-S212 (2004); Baldini, et al, Melanoma Res. 16:501 (2006); Gower, et al., Mol. Cell Biochem, 293:103 (2006); Lelievre, et al., J. Biol. Chem, 276(47):43668 (2001); Levin E. R. and Frank, H. J. L., Am. J. Physiol. 30:R453-R457 (1991)].

SUMMARY

The invention provides compounds having anti-cell proliferative activity, which share a conserved motif, which can be referred to as an "anticancer motif" which is predictive of anti-cell proliferative (e.g., anti-cancer, -neoplastic or -tumor) activity. Such compounds can optionally bind to NPRC, or optionally modulate NPRC activity. Invention compounds that contain the conserved motif but lack other structural elements of NPs or NPRC may be selective for treating cell proliferative disorders (e.g., cancer, neoplasia or tumors) and reduce one or more side effects caused by other structural elements, such as the occurrence of cardiovascular or other side effects mediated by other NPs or NPRs.

DETAILED DESCRIPTION

Figure 1:
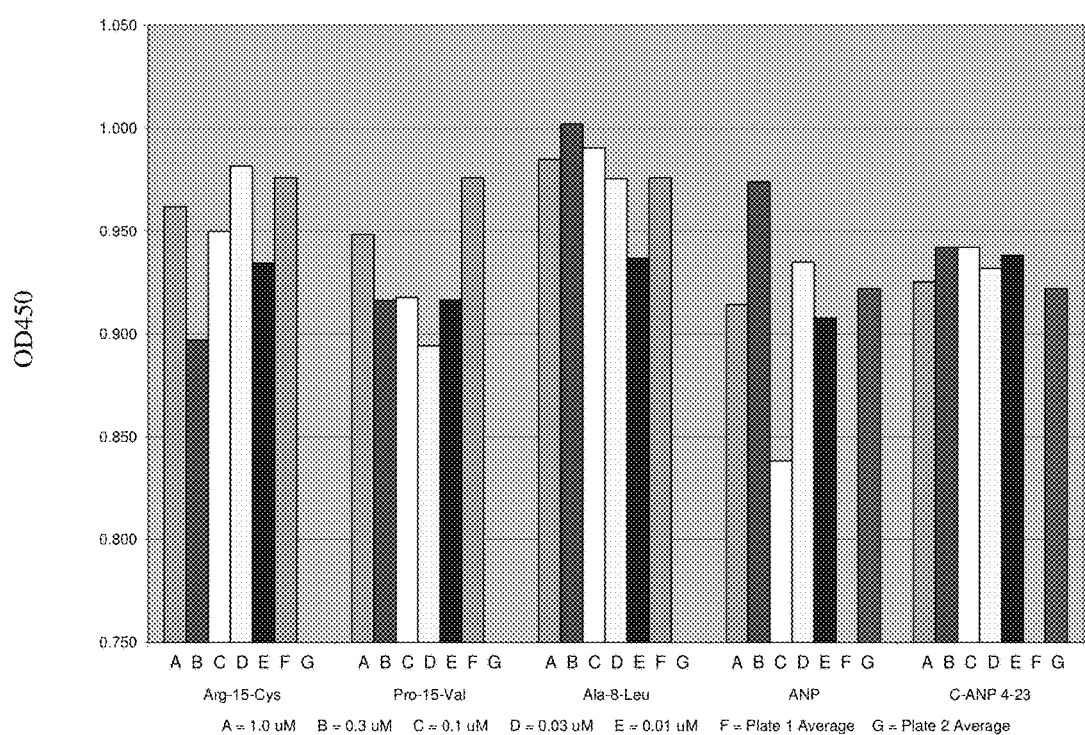
FIG. 1 is a bar chart showing antitumor activity of peptides: arg-15-cys, Pro-15-Val, Ala-8-Leu, VDL and C-ANP4-23.

Disclosed herein is a conserved motif that predicts anti-cell proliferative activity ("Anticancer Motif"). The invention therefore provides compounds with the conserved motif having anti-cell proliferative activity, as well as methods of using such compounds including, for example, methods for treating a cell proliferative disorder, methods of diagnosing a subject having increased probability of responding to treatment with such compounds, and methods of identifying (screening) for compounds having anti-cell proliferative activity. Furthermore, as disclosed herein the generic conserved motif structure and species within the generic conserved motif predicts structures of NP's, NP analogs, NP-related peptides, and small molecule NP mimetics, as well as additional compounds having anti-cell proliferative activity.

In various embodiments, a compound having anti-cell proliferative activity includes a conserved motif, namely, an eight residue compound, denoted (Res1)-(Res 2)-(Res 3)-(Res 4)-(Res 5)-(Res 6)-(Res 7)-(Res 8) [Formula I], wherein each of the residues are contiguous and are bonded (covalently or non-covalently) to their respective adjacent residue. The backbone of the conserved motif can be a linear or cyclic chain, such as a peptide or peptidomimetic chain, typically an amino acid sequence, which may be comprised of one or more naturally occurring amino acids or non-naturally amino acids (including d- or l-amino acids, alpha, beta or gamma amino acid, etc.). Appended to the conserved motif can be additional residues adjacent to any of the eight residues. Appended to the backbone can be side chains as set forth herein. Thus, (Res1)-(Res 2)-(Res 3)-(Res 4)-(Res 5)-(Res 6)-(Res 7)-(Res 8) can have additional residues (e.g., amino acids) adjacent to any of the residues of the conserved motif, as well as side chains appended to the backbone.

Deletion of a terminal residue does not completely attenuate activity, but rather decreases it significantly. For example, deletion of Res1 and Res8 of Formula 1 (both termini) is expected to decrease the activity proportionately more, without obliterating it altogether. Thus, a conserved motif also includes compounds, peptides and proteins containing the following anticancer conserved motif: (Res 2)-(Res 3)-(Res 4)-(Res 5)-(Res 6)-(Res 7) [Formula 2]; (Res 2)-(Res 3)-(Res 4)-(Res 5)-(Res 6)-(Res 7)-(Res 8) [Formula 3; and (Res1)-(Res 2)-(Res 3)-(Res 4)-(Res 5)-(Res 6)-(Res 7) [Formula 4].

Each of the residues (Res), referred to herein (as Res 1, Res 2, Res 3, Res 4, Res 5, Res 6, Res 7 and Res 8, respectively) are further defined hereinbelow, with increasing specificity. As will be evident, certain positions of the conserved motif allow for significant variation in structure, whereas others require that they are more particularly defined.

Res 1—is an amino acid or mimetic thereof, wherein the backbone is selected from an ether, ester, ketone, alkyl, alkylene or amide linker of 5 or less atoms, having a side chain selected from hydrophobic, non-polar, and non-ionizable side chain, selected from benzyl, alkyl, alkylene, alkenyl, alkylaryl of less than 12 carbons;

Res 2—is an amino acid or mimetic thereof, wherein the backbone is selected from an ether, ester, ketone, alkyl, alkylene or amide linker of 5 or less atoms, having a side chain which is an amphiphilic side chain, hydrophilic side chain, a zwitterion, Glycine (G), Lysine (K), Arginine (R), glutamine (Q), and Asparagine (N);

Res 3—is an amino acid or mimetic thereof, wherein the backbone is selected from an ether, ester, ketone, alkyl, alkylene or amide linker of 5 or less atoms, having a side chain less than 5 members long, except that any ring may be 5 or 6 members in size, and Glycine (G), Histidine (H) Asparagine (N), Serine (S), Leucine (L), or Alanine (A);

Res 4—is a linker of 5 or less atoms or an amino acid, an ether, ester, ketone, alkyl, alkylene, amide linker, with a side chain comprising from 1 to about 12 carbons and with constituents thereon selected from amino, hydroxyl, amido, carboxy, aryl, heteroaryl and any naturally occurring amino acid;

Res 5—is an amino acid or mimetic thereof, wherein the backbone is selected from an ether, ester, ketone, alkyl, alkylene or amide linker of 5 or less atoms, having a side chain selected from a hydrophobic, non-polar, non-ionizable, aliphatic, side chain, and Leucine (L), Isoleucine (I), Valine (V), Alanine (A), or Methionine (M);

Res 6—is an amino acid or mimetic thereof, wherein the backbone is selected from an ether, ester, ketone, alkyl, alkylene or amide linker 5 or less atoms, having a polar side chain, or amino acids Serine (S), Aspartic Acid (D), Arginine (R), and Glutamic Acid (E);

Res 7—is an amino acid or mimetic thereof, wherein the backbone is selected from an ether, ester, ketone, alkyl, alkylene or amide linker 5 or less atoms, with a side chain comprising from 1 to about 12 carbons and with constituents thereon selected from amino, hydroxyl, amido, carboxy, aryl, heteroaryl and any naturally occurring amino acid;

Res 8—is an amino acid or mimetic thereof, wherein the backbone is selected from an ether, ester, ketone, alkyl, alkylene or amide linker of 5 or less atoms, having a hydrophobic, non-polar, and non-ionizable side chain, and amino acids Alanine (A), Leucine (L), Isoleucine (I), Valine (V), having a side chain selected from C1 to C12 alkyl, alkylene, and alkenyl.

The conserved motif, as defined herein comprises a "backbone," and one or more "side chains" appended to the backbone. The term "backbone," by way of illustration, is a peptide made up of naturally occurring amino acids with a polyamide backbone made up of alpha amino acids. In nature these tend to be L-alpha-amino acids. Conserved motifs, and residues appended thereto can include one or more D-amino acids, and non(un)-natural amino acids, and these D-analogues, as well as any non(un)-natural amino acid's backbones are included within the definition of backbone. In addition, beta-amino acids, or gamma, delta or epsilon analogues, are also included in the backbone definition. As the motif includes peptidomimetics, other moieties to mimic the polyamide backbone, such mimetics can impart improved biological stability and greater half-life in a biological system (e.g., a subject), for example, due to, for example, to increased resistance to enzymatic degradation, increased circulation half life, increased bioavailability, increased efficacy, prolonged duration of effect, etc. When referring to peptidomimetics at one more of the residues, a "backbone" includes, for example, an ether, ester, ketone, alkyl, alkylene or amide linker, preferably of 5 or less atoms, with a "side chain" appended thereto.

The term "side chain" by way of illustration, in a naturally occurring peptide is made up of radical attached to the L-polyamide backbone, the 20 "side chains" referred to in the literature are widely known. In addition, less common side chains do occur in nature, some of which are derivatives of natural side chains—these are included in the definition of "side chain." Whether the side chain is attached to the backbone in an L- or D-configuration, or whether they are in a specific position in an alpha, beta, gamma, delta, or epsilon amino acid is irrelevant since all are included in the definition of side chain. The term side chain includes the panoply of functionality embodied in naturally occurring amino acids and variations thereof, hence sufhydryl, sulphone, carboxy, amino, amido, hydroxyl, alkyl, alkylaryl (or heteroaryl), aryl or heteroaryl radicals are all included in this definition. For example, exemplary hydrophobic side chains include, but are not limited to benzyl, alkyl, alkylene, alkenyl, alkylaryl of less than 12 carbons. The skilled artisan, in view of the specification understands the breadth and variety as to the term "side chain". As it relates to peptidomimetics, the backbone, has appended thereto 1-3 radicals, as defined above as side chains. Typically, up to 2 and more typically one side chain exists per residue (e.g., Res 1, Res, 2, . . . etc.)

For purposes of illustrating the conserved motif, oligopeptides using known amino acids, are exemplified not to limit the invention, but to illustrate the motif. For example, an oligopeptide, comprising about eight amino acids, forms a conserved anti-cell proliferative (anti-cancer, -neoplastic or -tumor) motif. Such motifs may exhibit increased anti-cell proliferative activity by increased length (e.g., 9, 10, 11, 12, 13, 14, 15, 16, 17, 8, 19, 20, etc., or more residues). Of course, peptidomimetics, including unnatural amino acids, derivatives and analogues at one or more positions of the sequence, whether within or outside of the conserved motif, are included.

Thus, the invention provides compounds having anti-cell proliferative activity having a conserved motif. In particular embodiments, motif denoted as (Res1)-(Res 2)-(Res 3)-(Res 4)-(Res 5)-(Res 6)-(Res 7)-(Res 8), is defined as:

Res 1—a hydrophobic, non-polar, and non-ionizable side chain, illustrated by amino acids including Phenylalanine (F), Alanine (A), Leucine (L), Isoleucine (I), Valine (V). Exemplary side chains include alkyl, alkylene, alkenyl, alkylaryl, and the like, typically of less than 12 carbons, more typically C1-C5 alkyl, or C1-C3 alkyl with an aryl substituent thereon.

Res 2—is an amphiphilic or hydrophilic side chain, which may include a zwitterion, illustrated by amino acids including Glycine (G), Lysine (K), Arginine (R), glutamine (Q), Asparagine (N).

Res 3 is a amino acid side chain which is small in size, typically a chain less than 5 members long, except that any ring may be 5 or 6 members in size, and more preferably C1 to C3 in length if alkyl, more preferably C0-C2, illustrated by amino acids including Glycine (G), Histidine (H) Asparagine (N), Serine (S), Leucine (L), Alanine (A).

Res 4—is a linker of about the size of an amino acid, with a side chain which may vary C1-C12, and have any constituent, as represented by the diversity found in the 20 naturally occurring amino acids. As a result an ether, ester, ketone, alkyl, alkylene or amide linker, with substituents thereon, of any similar size to an amino acid may be suitable.

Res 5—is a hydrophobic, non-polar, non-ionizable, aliphatic, side chain, as illustrated by amino acids including Leucine (L), Isoleucine (I), Valine (V), Alanine (A), or Methionine (M).

Res 6—is a polar side chain, illustrated by amino acids Serine (S), Aspartic Acid (D), Arginine (R), and Glutamic Acid (E).

Res 7—is a linker of about the size of an amino acid, with a side chain which may vary C1-C12, and have any constituent, as represented by the diversity found in the 20 naturally occurring amino acids. As a result an ether, ester, ketone, alkyl, alkylene or amide linker, with substituents thereon, of any similar size to an amino acid may be suitable.

Res 8—is a hydrophobic, non-polar, and non-ionizable side chain, illustrated by amino acids including, Alanine (A), Leucine (L), Isoleucine (I), Valine (V). Exemplary side chains will be alkyl, alkylene, alkenyl, and the like, typically of less than 12 carbons, more typically C1-C5 alkyl, or C1-C3 alkyl with an aryl substituent thereon.

Suitable side chains may be selected based on size, polarity, acidity or basicity, and hydrophobicity using the known structures, and known parameters such as those selected and illustrated below:

| AA 1 letter | Side chain | Hydro- phobic | pKa | Polar | pI | pH | Aromatic or Aliphatic | van der Waals volume |
|---|---|---|---|---|---|---|---|---|
| A | —CH$_3$ | X | — | — | 6.01 | — | — | 67 |
| C | —CH$_2$SH | X | 8.18 | — | 5.05 | acidic | — | 86 |
| D | —CH$_2$COOH | — | 3.90 | X | 2.85 | acidic | — | 91 |
| E | —CH$_2$CH$_2$COOH | — | 4.07 | X | 3.15 | acidic | — | 109 |
| F | —CH$_2$C$_6$H$_5$ | X | — | — | 5.49 | — | Aromatic | 135 |
| G | —H | — | — | — | 6.06 | — | — | 48 |
| H | —CH$_2$—C$_3$H$_3$N$_2$ | — | 6.04 | X | 7.60 | weak basic | Aromatic | 118 |
| I | —CH(CH$_3$)CH$_2$CH$_3$ | X | — | — | 6.05 | — | Aliphatic | 124 |
| K | —(CH$_2$)$_4$NH$_2$ | — | 10.54 | X | 9.60 | basic | — | 135 |
| L | —CH$_2$CH(CH$_3$)$_2$ | X | — | — | 6.01 | — | Aliphatic | 124 |
| M | —CH$_2$CH$_2$SCH$_3$ | X | — | — | 5.74 | — | — | 124 |
| N | —CH$_2$CONH$_2$ | — | — | X | 5.41 | — | — | 96 |
| P | —CH$_2$CH$_2$CH$_2$— | X | — | — | 6.30 | — | — | 90 |
| Q | —CH$_2$CH$_2$CONH$_2$ | — | — | X | 5.65 | — | — | 114 |
| R | —(CH$_2$)$_3$NH—C(NH)NH$_2$ | — | 12.48 | X | 10.76 | strongly basic | — | 148 |
| S | —CH$_2$OH | — | — | X | 5.68 | — | — | 73 |
| T | —CH(OH)CH$_3$ | — | — | X | 5.60 | weak acidic | — | 93 |
| U | —CH$_2$SeH | X | 5.73 | — | — | — | — | — |
| V | —CH(CH$_3$)$_2$ | X | — | — | 6.00 | — | Aliphatic | 105 |
| W | —CH$_2$C$_8$H$_6$N | X | — | — | 5.89 | — | Aromatic | 163 |
| Y | —CH$_2$—C$_6$H$_4$OH | — | 10.46 | X | 5.64 | — | Aromatic | 141 |

In addition, the substitution of one or more amino acids, alterations of the backbone for stability, derivatives, peptidomimetics and other alterations as described herein are also contemplated.

As disclosed herein, invention compounds that include a conserved motif can include additional residues (e.g., amino acids or mimetics thereof) adjacent to any of the residues of the conserved motif (e.g., any one of (Res1)-(Res 2)-(Res 3)-(Res 4)-(Res 5)-(Res 6)-(Res 7)-(Res 8)). Typically, the number of residues in an invention compound will total less than about 50 residues (e.g., amino acids or mimetics thereof), inclusive of the conserved motif. In various particular embodiments, the number of residues comprise from about 8 up to about 45 residues (e.g., amino acids or mimetics thereof). In additional embodiments, the number of residues comprise from about 8 up to about 30 residues (e.g., amino acids or mimetics thereof). In further embodiments, the number of residues comprise from about 8 up to about 25 residues (e.g., amino acids or mimetics thereof). In yet additional embodiments, the number of residues comprise from about 8 up to about 20 residues (e.g., amino acids or mimetics thereof), or between about 10 to 25, 10 to 20, or 10 to 16 residues (e.g., amino acids or mimetics thereof) in length.

While not intending to be bound by any particular theory or mechanism, the inventor has found that binding to the NPRC receptor can be predictive of anti-cell proliferative (e.g., anticancer) activity. Thus, although species having the conserved motif may be incapable of binding the NPRC receptor, typically those having the conserved motif are capable of binding the NPRC receptor, optionally selectively, and more typically are capable of binding the NPRC receptor with an equilibrium receptor binding affinity to the NPRC receptor, determined by the Ki value, in at least the micromolar range Furthermore, it appears that the conserved motif does not require the C residues required for a ring structure, nor the R14 residue that has been deemed critical for activity in all previously identified motifs.

The conserved motif is shared by ANP, CNP, the ANP-related peptides LANP, KP, VDL and the ANP analog, cANF, all of which have anticancer activity. CNP, which is less active than ANP, LANP, KP or VDL has a slightly larger amino acid side chain on one of the residues of the motif (L instead of G, A, N or S). BNP, which is inactive, has an even larger side chain at this position (K), and one which differs in electronic characteristics. Small molecule ANP mimetics, which also bind to NPRC, also have structures which are explainable based on the motif. For example, elimination of the equivalent of the R14 residue in one these molecules did not eliminate activity (Veale). Since the conserved anti-cell proliferative motif is significantly different from the previously described NP motifs, and NP motifs are believed to underlie the cardiovascular effects of these peptides, compounds that contain the anti-cell proliferative motif without the NP motif(s) are predicted to have anti-cell proliferative activity with fewer if any cardiovascular side effects of native peptides or proteins and are therefore included.

The conserved motif "residues" (i.e., amino acids or mimetics thereof) as well as their subunits, in this invention can be a) naturally or non-naturally occurring, b) produced by chemical synthesis, c) produced by recombinant DNA technology, d) produced by, chemical, biochemical or enzymatic fragmentation of larger molecules, e) produced by methods resulting from a combination of methods a through d listed above, or f) produced by any other means for producing peptides or amino acid sequences. By employing chemical synthesis, it is possible to introduce various amino acids which do not naturally occur into the construct, modify the N- or C-terminus, and the like, thereby providing improved stability (on the shelf or in vivo) and formulation, resistance to protease degradation, etc., and to introduce one or more amino acid surrogates into the construct.

The term "peptide" as used herein includes any structure comprised of two or more amino acids, including chemical modifications and derivatives of amino acids, covalently linked. The amino acids forming all or a part of a peptide may be naturally occurring amino acids, stereoisomers and modifications of such amino acids, non-protein amino acids, post-translationally modified amino acids (e.g., by glycosylation, ester or amide cleavage, etc.), enzymatically modified amino acids, amino acids with their side chain moiety either modified, derivatized from naturally occurring moieties, or are entirely synthetic, or not naturally occurring. The term "peptide" also includes dimers or multimers of peptides. A "manufactured" peptide includes a peptide produced by chemical synthesis, recombinant DNA technology, biochemical or enzymatic fragmentation of larger molecules, combinations of the foregoing or, in general, made by any other method involving manipulation by the hand of man.

The term "amino acid side chain moiety" as used herein includes any side chain of any amino acid, as the term "amino acid" is defined herein. This therefore includes the side chain moiety present in naturally occurring amino acids. It further includes side chain moieties in modified naturally occurring amino acids, such as side chain moieties in stereoisomers and modifications of naturally occurring protein amino acids, non-protein amino acids, post-translationally modified amino acids, enzymatically synthesized amino acids, derivatized amino acids, constructs or structures designed to mimic amino acids, etc. For example, the side chain moiety of any amino acid disclosed herein or known to one of skill in the art is included within the definition. A "derivative of an amino acid side chain moiety" is included within the definition of an amino acid side chain moiety.

The skilled artisan will recognize that amino acid side chain moieties can be derivatized, including a modification to or variation in either a naturally occurring or unnatural amino acid side chain moiety, wherein the modification or variation includes, for example, but is not limited to: (a) adding one or more saturated or unsaturated carbon atoms to an existing alkyl, aryl, or aralkyl chain; (b) substituting a carbon in the side chain with another atom, preferably oxygen or nitrogen; (c) adding a terminal group to a carbon atom of the side chain, including methyl (—CH3), methoxy (—OCH3), nitro (—NO2), hydroxyl (—OH), or cyano (—C≡N); (d) for side chain moieties including a hydroxy, thiol or amino groups, adding a suitable hydroxy, thiol or amino protecting group; or (e) for side chain moieties including a ring structure, adding one or ring substituents, including hydroxyl, halogen, alkyl, or aryl groups attached directly or through an ether linkage. For amino groups, suitable protecting groups are known to the skilled artisan. Provided such derivatization provides anti-cell proliferative activity in the final compound, all such derivatization is included in the definition of "amino acid side chain moiety."

The "amino acids" herein include the known naturally occurring protein amino acids, which are referred to by both their common three-letter abbreviation and single letter abbreviation (see generally Synthetic Peptides: A User's Guide, G. A. Grant, editor, W.H. Freeman & Co., New York (1992), which is incorporated herein by reference). An "amino acid" includes conventional alpha-amino acids as well as beta-amino acids, alpha, alpha disubstituted amino acids and N-substituted amino acids wherein at least one side chain is an amino acid side chain moiety as defined herein. An "amino acid" further includes N-alkyl alpha-amino acids, wherein the N-terminus amino group has a C1 to C6 linear or branched alkyl substituent. The term "amino acid" therefore includes stereoisomers and modifications of naturally occurring protein amino acids, non-protein amino acids, post-translationally modified amino acids, enzymatically synthesized amino acids, derivatized amino acids, constructs or structures designed to mimic amino acids, etc. Modified and unusual amino acids are included in the compounds of the invention and are described generally, for example, in Synthetic Peptides: A User's Guide, cited above; Hruby V. J., Al-obeidi F., Kazmierski W., Biochem. J. 268:249-262 (1990); and Toniolo C., Int. J. Peptide Protein Res. 35:287 (1990), which are incorporated herein by reference.

In addition, the following amino acids and protecting and modifying groups thereof, are included: gamma-amino butyric acid, 12-amino dodecanoic acid, alpha-aminoisobutyric acid, 6-amino hexanoic acid, 4-(aminomethyl)-cyclohexane carboxylic acid, 8-amino octanoic acid, biphenylalanine, Boc-t-butoxycarbonyl, benzyl, benzoyl, citrulline, diaminobutyric acid, pyrrollysine, diaminopropionic acid, 3,3-diphenylalanine, orthonine, citrulline, 1,3-dihydro-2H-isoindolecarboxylic acid, ethyl, Fmoc-fluorenylmethoxycarbonyl, heptanoyl (CH3-(CH2)$_5$-C(=O)—), hexanoyl (CH3-(CH2)4-C(=O)—), homoarginine, homocysteine, homolysine, homophenylalanine, homoserine, methyl, methionine sulfoxide, methionine sulfone, norvaline (NVA), phenylglycine, propyl, isopropyl, sarcosine (SAR), tert-butylalanine, benzyloxycarbonyl In the compounds of the invention, conventional amino acid residues have their conventional meaning. Thus, "Nle" is norleucine, and so on. While it is expected that either D or L residues are active and are included in the invention, for the purposes of the examples, and to save space and time in the Sequence Listing information, residues listed in examples are in the L-isomer configuration unless the D-isomer is specified, for example, as in "D-Ala" or "D-A" for D-Alanine. Nevertheless, D-amino acids at any or all positions of the compounds of the invention are included.

A single amino acid, including stereoisomers and modifications of naturally occurring protein amino acids, non-protein amino acids, post-translationally modified amino acids, enzymatically synthesized amino acids, non-naturally occurring amino acids including derivatized amino acids, an alpha, alpha disubstituted amino acid derived from any of the foregoing (i.e., an alpha, alpha disubstituted amino acid, wherein at least one side chain is the same as that of the residue from which it is derived), a beta-amino acid derived from any of the foregoing (i.e., a beta-amino acid which other than for the presence of a beta-carbon is otherwise the same as the residue from which it is derived) etc., including all of the foregoing can be referred to herein as a "residue." Suitable substituents, in addition to the side chain moiety of the alpha-amino acid, include C1 to C6 linear or branched alkyl. Aib is an example of an alpha, alpha disubstituted amino acid. While alpha, alpha disubstituted amino acids can be referred to using conventional L- and D-isomeric references, it is to be understood that such references are for convenience, and that where the substituents at the alpha-position are different, such amino acid can interchangeably be referred to as an alpha, alpha disubstituted amino acid derived from the L- or D-isomer, as appropriate, of a residue with the designated amino acid side chain moiety. Thus (S)-2-Amino-2-methyl-hexanoic acid can be referred to as either an alpha, alpha disubstituted amino acid derived from L-Nle or as an alpha, alpha disubstituted amino acid derived from D-Ala. Similarly, Aib can be referred to as an alpha, alpha disubstituted amino acid derived from Ala. Whenever an alpha, alpha disubstituted amino acid is provided, it is to be understood as including all (R) and (S) configurations thereof.

An "N-substituted amino acid" includes any amino acid wherein an amino acid side chain moiety is covalently bonded to the backbone amino group, optionally where there are no substituents other than H in the alpha-carbon position. Sarcosine is an example of an N-substituted amino acid. By way of example, sarcosine can be referred to as an N-substituted amino acid derivative of Ala, in that the amino acid side chain moiety of sarcosine and Ala is the same, methyl.

The term "peptidomimetic" includes a molecule disclosed herein which is a mimic of a residue (referred to as a "mimetic"), including but not limited to piperazine core molecules, keto-piperazine core molecules and diazepine core molecules. Unless otherwise specified, an amino acid mimetic of an invention compound includes both a carboxyl group and amino group, and a group corresponding to an amino acid side chain, or in the case of a mimetic of Glycine, no side chain other than hydrogen.

By way of example, these would include compounds which mimic the sterics, surface charge distribution, polarity, etc. of a naturally occurring amino acid, but need not be an amino acid, which would impart stability in the biological system. For example, Proline may be substituted by other lactams or lactones of suitable size and substitution; Leucine may be substituted by an alkyl ketone, N-substituted amide, as well as variations in amino acid side chain length using alkyl, alkenyl or other substituents, others may be apparent to the skilled artisan. The essential element of making such substitutions is to provide a molecule of roughly the same size and charge and configuration as the residue used to design the molecule. Refinement of these modifications will be made by testing the compounds in a binding or other assay, and comparing the structure activity relationship. Such methods are within the scope of the skilled artisan working in medicinal chemistry and drug development.

It will be appreciated that the compounds of the invention can have more than one asymmetric center, and are therefore capable of existing in more than one stereoisomeric form. Some of the compounds may also exist as geometric isomers and rotamers. Furthermore, some compounds of the invention may also have conformational axial chirality. The invention extends to each of these forms individually and to mixtures thereof, including racemates. In one aspect, isomers may be separated conventionally by chromatographic methods or by use of a resolving agent. In another aspect, individual isomers, or enantiomerically pure isomers, are prepared by synthetic schemes, such as those disclosed herein or variants of such schemes, employing asymmetric synthesis using chiral intermediates, reagents or catalysts.

Either terminus of the conserved motif, or any peptide comprising the conserved motif, may be protected from degradation by any terminal group. For example, at the C-terminus a terminal group attached through the terminal carbon atom or, if provided, terminal carboxyl group, of the C-terminus of a construct attached thereto. The terminal ring carbon atom or, if provided, terminal carboxyl group, may form a part of a residue, or may form a part of an amino acid surrogate. For example, the C-terminus capping group forms a part of an amino acid surrogate which is at the C-terminus position of the construct. The C-terminus capping group includes, but is not limited to, —(CH2)n-OH, —(CH2)n-C(=O)—OH, —(CH2)m-OH, —(CH2)n-C(=O)—N(V1)(V2), —(CH2)n-C(=O)—(CH2)m-N(V1)(V2), —(CH2)n-O—(CH2)m-CH3, —(CH2)n-C(=O)—NH—(CH2)m-CH3, —(CH2)n-C(=O)—NH—(CH2)m-N(V1)(V2), —(CH2)n-C(=O)—N—((CH2)m-N(V1)(V2))-2, —(CH2)n-C(=O)—NH—CH(—C(=O)—OH)—(CH2)-m-N(V1)(V2), —C(=O)—NH—(CH2)m-NH—C(=O)—CH(N(V1)(V2))-((CH2)m-N(V1)(V2)), or —(CH2)n-C(=O)—NH—CH(—C(=O)—NH2)-(CH2).-m-N(V1)(V2), including all (R) or (S) configurations of the foregoing, where V1 and V2 are each independently H, a C1 to C7 linear or branched alkyl chain, m is 0 to 7 and n is 0 to 2; or any omega amino aliphatic, terminal aryl or aralkyl, including groups such as methyl, dimethyl, ethyl, propyl, isopropyl, butyl, isobutyl, pentyl, hexyl, allyl, cyclopropane methyl, hexanoyl, heptanoyl, acetyl, propionoyl, butanoyl, phenylacetyl, cyclohexylacetyl, naphthylacetyl, cinnamoyl, phenyl, benzyl, benzoyl, 7'-amino heptanoyl, other groups known in the art, or any single natural or unnatural alpha-amino acid, beta-amino acid or alpha, alpha disubstituted amino acid, including all chiral configurations of the foregoing, optionally in combination with any of the foregoing non-amino acid capping groups.

The N-terminus of the compound including a conserved motif, or a peptide comprising the motif, may be protected from degradation by any terminal group attached through the terminal group attached through the terminal amine of the N-terminus of a construct. The terminal amine may form a part of a residue, or may form a part of an amino acid surrogate. For example, the N-terminus capping group forms a part of an amino acid surrogate, which is at the N-terminus position of the construct. The N-terminus capping group includes, but is not limited to, any omega amino aliphatic, acyl group or terminal aryl or aralkyl including groups such as methyl, dimethyl, ethyl, propyl, isopropyl, butyl, isobutyl, pentyl, hexyl, allyl, cyclopropane methyl, hexanoyl, heptanoyl, acetyl, propionoyl, butanoyl, phenylacetyl, cyclohexylacetyl, naphthylacetyl, cinnamoyl, phenyl, benzyl, benzoyl, 7'-amino heptanoyl, other groups known in the art, or alternatively an N-terminus capping group is —(CH2)m-NH(V3), —(CH2)m-CH3, —C(=O)—(CH2)m-CH3, —C(=O)—(CH2)m-NH(V3), —C(=O)—(CH2)m-C(=O)—OH, —C(=O)—(CH2)m-C(=O)—(V4), —(CH2)m-C(=O)—OH, —(CH2)m-C(=O)—(V4), C(=O)—(CH2)m-O(V3), —(CH2)m-O(V3), C(=O)—(CH2)m-S(V3), or —(CH2)m-S(V3), where V3 is H or a C1 to C17 linear or branched alkyl chain, and V4 is a C1 to C17 linear or branched alkyl chain and m is 0 to 17. A phenyl ring is "substituted" when the phenyl ring includes one or more substituents independently comprising hydroxyl, halogen, alkyl, or aryl groups attached directly or through an ether linkage. Where the phenyl ring is so substituted, the amino acid residue may be referred to as substituted, as in substituted Phe, substituted HPhe.

The variations can be made using methods known to one skilled in the art such as oligonucleotide-mediated (site-directed) mutagenesis, alanine scanning, and PCR mutagenesis. Site-directed mutagenesis [Carter et al., Nucl. Acids Res., 13:4331 (1986); Zoller et al., Nucl. Acids Res., 10:6487 (1987)], cassette mutagenesis [Wells et al., Gene, 34:315 (1985)], restriction selection mutagenesis [Wells et al., Philos. Trans. R. Soc. London SerA, 317:415 (1986)] and other techniques can be performed on the cloned DNA to produce invention compounds or variations, derivatives, substitutions or modifications thereof.

Covalent modifications of the compound are included within the invention. One type of covalent modification includes reacting targeted amino acid residues with an organic derivatizing agent that is capable of reacting with selected side chains or the N- or C-terminal residues of the peptide. Derivatization with bifunctional agents is useful, for instance, for cross linking peptide to a water-insoluble support matrix or surface for use in the method for purifying anti-peptide antibodies, and vice-versa. Commonly used cross linking agents include, e.g., 1,1-bis(diazoacetyl)-2-phenylethane, glutaraldehyde, N-hydroxysuccinimide esters, for example, esters with 4-azidosalicylic acid, homo-bifunctional imidoesters, including disuccinimidyl esters such as 3,3'-dithiobis(succinimidylpropionate), bifunctional maleimides such as bis-N-maleimido-1,8-octane and agents such as methyl-3-[(p-azidophenyl)dithio]propioimidate.

Other modifications include deamidation of glutaminyl and asparaginyl residues to the corresponding glutamyl and aspartyl residues, respectively, hydroxylation of proline and lysine, phosphorylation of hydroxyl groups of seryl or threonyl residues, methylation of the alpha-amino groups of lysine, arginine, and histidine side chains [T. E. Creighton, Proteins: Structure and Molecular Properties, W.H. Freeman & Co., San Francisco, pp. 79-86 (1983)], acetylation of the N-terminal amine, amidation of any C-terminal carboxyl group, etc.

Another type of covalent modification of the one or more residues of the compound of the invention includes glycosylation. "Glycosylation" is intended to mean adding or deleting one or more carbohydrate moieties (either by removing the underlying glycosylation site or by deleting the glycosylation by chemical and/or enzymatic means), and/or adding one or more glycosylation sites that may or may not be present in the native sequence. In addition, the phrase includes qualitative changes in the glycosylation of the native proteins, involving a change in the nature and proportions of the various carbohydrate moieties present.

Addition of glycosylation sites to the compound can be accomplished by altering the amino acid sequence. The alteration may be made, for example, by the addition of, or substitution by, one or more serine or threonine residues (for O-linked glycosylation sites) or asparagine (N-linked glycosylation site) to the compound. Of course, the compound may optionally be altered through changes at the DNA level, particularly by mutating the DNA encoding the peptide polypeptide at preselected bases such that codons are generated that will translate into the desired amino acids. Another means of increasing the number of carbohydrate moieties on the peptide polypeptide is by chemical or enzymatic coupling of glycosides to the polypeptide (see, for example, in WO 87/05330; and in Aplin and Wriston, CRC Crit. Rev. Biochem., pp. 259 (1981)). Removal of carbohydrate moieties may be accomplished chemically or enzymatically or by mutational substitution of codons encoding for amino acid residues that serve as targets for glycosylation. Chemical deglycosylation techniques are known (see, for example, Hakimuddin, et al., Arch. Biochem. Biophys., 259:52 (1987) and Edge et al., Anal. Biochem., 118:131 (1981)). Enzymatic cleavage of carbohydrate moieties on polypeptides can be achieved by the use of a variety of endo- and exo-glycosidases (see, for example, Thotakura et al., Meth. Enzymol. 138:350 (1987)).

Another type of covalent modification includes linking the compound to any of a variety of nonproteinaceous polymers, e.g., polyethylene glycol (PEG), polypropylene glycol, or polyoxyalkylenes (see, for example, U.S. Pat. Nos. 4,640,835; 4,496,689; 4,301,144; 4,670,417; 4,791,192 and 4,179,337).

The compounds of the invention can also be modified to form a chimeric molecule. In accordance with the invention, there are provided compounds that include a heterologous domain. A heterologous domain can be an addition or insertion. A heterologous domain can consist of any of a variety of different types of small or large functional moieties. Particular non-limiting examples of heterologous domains include, for example, tags, detectable labels and cytotoxic agents. Such moieties include peptides, nucleic acids, carbohydrate, lipid or small organic compounds, such as a drug (e.g., a cell proliferative agent), metals (gold, silver), etc.

Specific examples of tags and detectable labels include enzymes (horseradish peroxidase, urease, catalase, alkaline phosphatase, beta-galactosidase, chloramphenicol transferase); enzyme substrates; ligands (e.g., biotin); receptors (avidin); radionuclides (e.g., $C^{14}$, $S^{35}$, $P^{32}$, $P^{33}$, $H^3$, $I^{125}$, $I^{131}$, gallium-67 and 68, scantium-47, indium-111, radium-223); T7-, His-, myc-, HA- and FLAG-tags; electron-dense reagents; energy transfer molecules; paramagnetic labels; fluorophores (fluorescein, rhodamine, phycoerthrin); chromophores; chemi-luminescent (imidazole, luciferase); and bio-luminescent agents. Specific examples of cytotoxic agents include diptheria, toxin, cholera toxin and ricin.

In one embodiment, a heterologous domain comprises a peptide, heterologous polypeptide or an amino acid sequence fused to a compound. A chimeric molecule can include a fusion of the compound with a tag polypeptide which provides an epitope to which an anti-tag antibody can selectively bind. The epitope tag is generally placed at the end of the compound, e.g., at the amino- or carboxyl-terminus. The epitope-tagged forms can be detected using an antibody against the tag polypeptide. Also, the epitope tag enables the compound to be readily purified by affinity purification using an anti-tag antibody or another type of affinity matrix that binds to the epitope tag. Various tag polypeptides and their respective antibodies are known to the skilled artisan. In an alternative embodiment, the chimeric molecule may comprise a fusion of the compound with an immunoglobulin or a particular region of an immunoglobulin. For a bivalent form of the chimeric molecule (also referred to as an "immunoadhesin"), such a fusion could be to the Fc region of an IgG molecule.

Additional examples of heterologous domains include, for example, anti-cell proliferative agents (e.g., anti-neoplastic, anti-tumor or anti-cancer, or anti-metastasis agents). Specific non-limiting examples of anti-cell proliferative agents are disclosed herein and known in the art.

Linker sequences may be inserted between the compound, and the heterologous domain so that the two entities maintain, at least in part, a distinct function or activity. Linker sequences may have one or more properties that include a flexible structure, an inability to form an ordered secondary structure or a hydrophobic or charged character which could promote or interact with either domain. Amino acids typically found in flexible protein regions include Gly, Asn and Ser. Other near neutral amino acids, such as Thr and Ala, may also be used in the linker sequence. The length of the linker sequence may vary (see, e.g., U.S. Pat. No. 6,087,329). Linkers further include chemical cross-linking and conjugating agents, such as sulfo-succinimidyl derivatives (sulfo-SMCC, sulfo-SMPB), disuccinimidyl suberate (DSS), disuccinimidyl glutarate (DSG) and disuccinimidyl tartrate (DST).

The term "isolated" used as a modifier of a compound means that the compound is manipulated or made by the hand of man or is separated from one or more other components in their naturally occurring in vivo environment. Generally, if such compounds exist naturally, the compounds are separated to be substantially free of one or more materials with which they normally associate with in nature, for example, one or more protein, nucleic acid, lipid, carbohydrate, cell membrane, etc. Thus, an isolated compound is substantially separated from other biological components in the cell of the organism in which the compound naturally occurs, or from the artificial medium in which it is produced (e.g., synthetically or through cell culture). For example, an isolated polypeptide is substantially separated from other polypeptides and nucleic acid and does not include a library of polypeptides or polynucleotides present among millions of polypeptide or nucleic acid sequences, such as a polypeptide, genomic or cDNA library, for example.

The term "isolated" does not exclude alternative physical forms of the compound, for example, an isolated peptide could include peptide multimers, disulfide linkages within or with other peptides, post-translational modifications (e.g., glycosylation, phosphorylation) and modified or derivatized forms. The term isolated is also intended not to exclude compounds of the invention having anti-cell proliferative activity that are present in a subject after administration. Such compounds in a subject can result from administration of the compound to the subject, or conversion of a prodrug form to a compound after the prodrug is administered to a subject. Thus, it is expressly intended that the compounds of the invention include prodrugs that convert to an invention compound subsequent to administration to a subject.

The term "purified" used as a modifier of a compound refers to a compound free of most or all of the materials with which it typically associates with in nature. Thus, a compound separated from cells is considered to be purified when separated from cellular components, while a chemically synthesized compound is considered to be substantially purified when separated from its chemical precursors. Purified therefore does not require absolute purity. Furthermore, a "purified" compound can be combined with one or more other molecules. Thus, the term "purified" does not exclude compound combinations.

"Purified" compounds include compounds produced by standard purification methods. The term also includes proteins and nucleic acids produced by recombinant expression in a host cell as well as chemical synthesis. "Purified" can also refer to a compound in which the level of contaminants is below a level that is acceptable to a regulatory agency for administration to a human or non-human animal, for example, the Food and Drug administration (FDA).

Substantial purity can be at least about 60% or more of the molecule by mass. Purity can also be about 70% or 80% or more, and can be greater, for example, 90% or more. Purity can be less, for example, in a pharmaceutical carrier the amount of a molecule by weight % can be less than 60% but the relative proportion of the compound compared to other components with which it is normally associated with will be greater. Purity can be determined by any appropriate method, including, for example, UV spectroscopy, chromatography (e.g., HPLC, gas phase), gel electrophoresis (e.g., silver or coomassie staining) and sequence analysis (peptide and nucleic acid).

The invention includes in vivo methods. For example, a cell such as an undesirably proliferating cell or cell proliferative disorder can be present in a subject, such as a mammal (e.g., a human subject). A subject having such cells may therefore be treated by administering, for example, a compound of the invention, optionally that has been shown to bind to such cells pr to NPs.

In accordance with the invention, there are provided methods of treating undesirable cell proliferation or a cell proliferative or hyperproliferative disorder in a subject. Such methods can be practiced with any of the compounds of the invention set forth herein. In one embodiment, a method includes administering to a subject an amount of compound having a conserved motif, effective to treat the undesirable cell proliferation or a cell proliferative or hyperproliferative disorder in the subject.

As used herein, the terms "cell proliferative disorder" and "hyperproliferative disorder" and grammatical variations thereof, when used in reference to a cell, tissue or organ, refers to any undesirable, excessive or abnormal cell, tissue or organ growth, proliferation, survival differentiation or failure to differentiate. A hyperproliferative cell denotes a cell whose growth, proliferation, or survival is greater than desired or is abnormal, such as compared to a reference normal cell, e.g., a cell that is of the same tissue or organ but is not a hyperproliferative cell, or a cell that fails to differentiate normally or completely. Undesirable cell proliferation and hyperproliferative disorders include diseases and physiological conditions, both benign hyperplastic conditions characterized by undesirable, excessive or abnormal cell numbers, cell growth, cell proliferation, cell survival or differentiation in a subject. Specific examples of such disorders include non-metastatic and metastatic neoplasia, tumors and cancers (malignancies), whether primary or secondary to the primary lesion. Additional examples include benign hyperplasia (e.g., skin tags, mylodisplasia, precancerous lesions, and benign prostatic hypertrophy (BPH)) and other disorders not characterized as a tumor, cancer or neoplasia but having features of abnormal or undesirable cell growth, proliferation or survival, such as fibrosis, scarring, cysts, psoriasis, athersclerosis, etc.

In various embodiments, a method includes administering to a subject a compound of the invention in an amount effective to treat the cell proliferative or hyperproliferative disorder in the subject. In particular aspects, the disorder is a neoplasia, tumor or metastatic or non-metastatic cancer (malignancy). In additional aspects, the disorder affects or is present in part at least in breast, lung, thyroid, head and neck, nasopharynx, nose or sinuses, brain, spine, adrenal gland, thyroid, lymph, gastrointestinal (mouth, esophagus, stomach, duodenum, ileum, jejunum (small intestine), colon, rectum), genito-urinary tract (uterus, ovary, cervix, bladder, testicle, penis, prostate), kidney, pancreas, adrenal gland, liver, bone, bone marrow, lymph, blood, muscle, skin, or hematopoetic system.

The terms "tumor," "cancer" and "neoplasia" are used interchangeably and refer to a cell or population of cells whose growth, proliferation or survival is greater than growth, proliferation or survival of a normal counterpart cell, e.g. a cell proliferative or differentiative disorder. Typically, the growth is uncontrolled. The term "malignancy" refers to invasion of nearby tissue. The term "metastasis" refers to spread or dissemination of a tumor, cancer or neoplasia to other sites, locations, regions or organ or tissue systems within the subject, in which the sites, locations regions or organ or tissue systems are distinct from the primary tumor, cancer or neoplasia.

Invention methods can be used to reduce or inhibit primary or secondary (or any lesion subsequent to the primary lesion) tumor, cancer or neoplastic cell growth, proliferation, or survival; reduce or inhibit tumor, cancer or neoplastic malignancy or growth or invasion into nearby tissue, reduce or inhibit tumor, cancer or neoplastic metastasis of a primary tumor, cancer or neoplasia to other sites, regions or systems, or the formation or establishment of metastatic tumors, cancers or neoplasias at other sites, regions or systems distinct from the primary tumor, cancer or neoplasia thereby inhibiting or reducing relapse or progression. Thus, methods of the invention include, among other things, 1) reducing or inhibiting growth, proliferation, survival, mobility or invasiveness of a primary tumor, cancer or neoplasia; 2) reducing or inhibiting growth, proliferation, survival, mobility or invasiveness of a primary tumor, cancer or neoplasia that potentially or does develop metastases; 3) reducing or inhibiting formation or establishment of metastases arising from a primary tumor, cancer or neoplasia to one or more other sites, locations, regions or systems distinct from the primary tumor, cancer or neoplasia; 4) reducing or inhibiting growth or proliferation of a metastasis at one or more other sites, locations, regions or systems distinct from the primary tumor, cancer or neoplasia after a metastasis has formed or has been established; and 5) reducing or inhibiting formation or establishment of additional metastasis after the metastasis has been formed or established.

Neoplasias, tumors and cancers include a sarcoma, carcinoma, adenocarcinoma, melanoma, myeloma, blastoma, glioma, lymphoma or leukemia. Exemplary cancers include, for example, carcinoma, sarcoma, adenocarcinoma, melanoma, neural (blastoma, glioma), mesothelioma and reticuloendothelial, lymphatic or haematopoietic neoplastic disorders (e.g., myeloma, lymphoma or leukemia). In particular aspects, a neoplasia, tumor or cancer includes a lung adenocarcinoma, lung carcinoma, diffuse or interstitial gastric carcinoma, colon adenocarcinoma, prostate adenocarcinoma, esophagus carcinoma, breast carcinoma, pancreas adenocarcinoma, ovarian adenocarcinoma, or uterine adenocarcinoma.

Neoplasia, tumors and cancers include benign, malignant, metastatic and non-metastatic types, and include any stage (I, II, III, IV or V) or grade (G1, G2, G3, etc.) of neoplasia, tumor, or cancer, or a neoplasia, tumor, cancer or metastasis that is progressing, worsening, stabilized or in remission.

Neoplasias, tumors and cancers can arise from a multitude of primary tumor types, including but not limited to breast, lung, thyroid, head and neck, nasopharynx, nose or sinuses, brain, spine, adrenal gland, thyroid, lymph, gastrointestinal (mouth, esophagus, stomach, duodenum, ileum, jejunum (small intestine), colon, rectum), genito-urinary tract (uterus, ovary, cervix, bladder, testicle, penis, prostate), kidney, pancreas, adrenal gland, liver, bone, bone marrow, lymph, blood, muscle, skin, and the hematopoetic system, and may metastasize to secondary sites.

A "solid neoplasia, tumor or cancer" refers to neoplasia, tumor or cancer (e.g., metastasis) that typically aggregates together and forms a mass. Specific examples include visceral tumors such as melanomas, breast, pancreatic, uterine and ovarian cancers, testicular cancer, including seminomas, gastric or colon cancer, hepatomas, adrenal, renal and bladder carcinomas, lung, head and neck cancers and brain tumors/cancers.

Carcinomas refer to malignancies of epithelial or endocrine tissue, and include respiratory system carcinomas, gastrointestinal system carcinomas, genitourinary system carcinomas, testicular carcinomas, breast carcinomas, prostatic carcinomas, endocrine system carcinomas, and melanomas. Additional carcinomas can form from the uterine/cervix, lung, head/neck, colon, pancreas, testes, adrenal gland, kidney, esophagus, stomach, liver and ovary. The term also includes carcinosarcomas, e.g., which include malignant tumors composed of carcinomatous and sarcomatous tissues.

Adenocarcinoma includes a carcinoma of a glandular tissue, or in which the tumor forms a gland like structure. Non-limiting examples include adenocarcinoma or a squamous cell carcinoma, such as an adenocarcinoma of stomach, lung, pancreas, colon, breast, or esophagus squamous cell carcinoma. Further non-limiting examples include a carcinoid carcinoma, invasive ductal carcinoma, germ cell carcinoma in any of stomach, lung, colon, pancreas, esophagus, prostate, breast or testis.

Melanoma refers to malignant tumors of melanocytes and other cells derived from pigment cell origin that may arise in the skin, the eye (including retina), or other regions of the body.

Sarcomas refer to malignant tumors of mesenchymal cell origin. Exemplary sarcomas include for example, lymphosarcoma, liposarcoma, osteosarcoma, chondrosarcoma, leiomyosarcoma, rhabdomyosarcoma and fibrosarcoma.

Neural neoplasias include glioma, glioblastoma, meningioma, neuroblastoma, retinoblastoma, astrocytoma, oligodendrocytoma Specific non-limiting examples of neoplasias, tumors and cancers include malignant and non-malignant neoplasias, tumors and cancers, and metastasis of any severity, e.g., grade or stage. In particular, gastric (stomach) tissue, lung squamous cell carcinoma, and lung adenocarcinoma cell of any stage (e.g., stages IA, IB, IIA, IIB, IIIA, IIIB or IV) or grade (e.g., grades G1, G2 or G3).

A "liquid neoplasia, tumor or cancer" refers to a neoplasia, tumor or cancer of the reticuloendothelial or hematopoetic system, such as a lymphoma, myeloma, or leukemia, or a neoplasia that is diffuse in nature. Particular examples of leukemias include acute and chronic lymphoblastic, myeloblastic and multiple myeloma. Typically, such diseases arise from poorly differentiated acute leukemias, e.g., erythroblastic leukemia and acute megakaryoblastic leukemia. Specific myeloid disorders include, but are not limited to, acute promyeloid leukemia (APML), acute myelogenous leukemia (AML) and chronic myelogenous leukemia (CML); lymphoid malignancies include, but are not limited to, acute lymphoblastic leukemia (ALL), which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Specific malignant lymphomas include, non-Hodgkin lymphoma and variants, peripheral T cell lymphomas, adult T cell leukemia/lymphoma (ATL), cutaneous T-cell lymphoma (CTCL), large granular lymphocytic leukemia (LGF), Hodgkin's disease and Reed-Sternberg disease.

As used herein, the terms "treat," "treating," "treatment" and grammatical variations thereof mean subjecting an individual patient to a protocol, regimen, process or remedy, in which it is desired to obtain a physiologic response or outcome in that patient. Since every treated patient may not respond to a particular treatment protocol, regimen, process or remedy, treating does not require that the desired physiologic response or outcome be achieved in each and every patient or patient population. Accordingly, a given patient or patient population may fail to respond or respond inadequately to treatment.

Administration methods of the invention may be practiced by any mode of administration or by any route including, for example, systemic, regional and local administration, such as at the site of a cell proliferative disorder. For example, a cell proliferative disorder which is on or under the skin may be treated by local injection, whereas a cell proliferative disorder affecting the bone marrow may require systemic administration. Exemplary administration routes include intravenous, intrarterial, intradermal, intramuscular, subcutaneous, intra-pleural, transdermal (topical), transmucosal, intra-cranial, intra-spinal, intra-ocular, rectal, oral (alimentary) and mucosal. Particular routes of administration can be based in part upon the type or location of the cell proliferative disorder, as well as pharmacology, bioavailability, stability of the compound, etc.

Methods of the invention include, among other things, methods that provide a detectable or measurable improvement in a condition of a given subject, such as alleviating or ameliorating one or more adverse (physical) symptoms or consequences associated with the presence of a cell proliferative or cellular hyperproliferative disorder, neoplasia, tumor or cancer, or metastasis, i.e., a therapeutic benefit or a beneficial effect.

A therapeutic benefit or beneficial effect is any objective or subjective, transient, temporary, or long-term improvement in the cell proliferative disorder, or a reduction in onset, severity, duration or frequency of an adverse symptom associated with or caused by cell proliferation or a hyperproliferative disorder such as a neoplasia, tumor or cancer, or metastasis. A satisfactory clinical endpoint of a treatment method in accordance with the invention is achieved, for example, when there is an incremental or a partial reduction in severity, duration or frequency of one or more associated pathologies, adverse symptoms or complications, or inhibition or reversal of one or more of the physiological, biochemical or cellular manifestations or characteristics of cell proliferation or a hyperproliferative disorder such as a neoplasia, tumor or cancer, or metastasis. A therapeutic benefit or improvement therefore can be a cure, such as destruction of target proliferating cells (e.g., neoplasia, tumor or cancer, or metastasis) or ablation of one or more, most or all pathologies, adverse symptoms or complications associated with or caused by cell proliferation or the hyperproliferative disorder such as a neoplasia, tumor or cancer, or metastasis. However, a therapeutic benefit or improvement need not be a cure or complete destruction of all target proliferating cells (e.g., neoplasia, tumor or cancer, or metastasis) or ablation of all pathologies, adverse symptoms or complications associated with or caused by cell proliferation or the cellular hyperproliferative disorder such as a neoplasia, tumor or cancer, or metastasis. For example, partial destruction of a tumor, cancer or neoplasia cell mass or cells, or a stabilization of the tumor, cancer or neoplasia mass, size or cell numbers by inhibiting, slowing, or delaying progression or worsening of the tumor, cancer or neoplasia, can reduce or delay mortality and prolong lifespan even if only for a few days, weeks or months, even if a portion or the bulk of the tumor, cancer or neoplasia mass, size or cells remain.

Specific non-limiting examples of therapeutic benefit include a reduction in tumor, cancer or neoplasia, or metastasis volume (size or cell mass) or numbers or proliferation of cells, inhibiting or preventing an increase in tumor, cancer or neoplasia volume, size, mass, or cell numbers (e.g., stabilizing), slowing, delaying or inhibiting neoplasia, tumor or cancer malignancy, progression, worsening or metastasis, stimulating, inducing or increasing tumor, cancer or neoplasia cell lysis, apoptosis or differentiation, or inhibiting neoplasia, tumor or cancer cell proliferation, growth or metastasis. An invention method may not take effect immediately. For example, treatment may be followed by an increase in the tumor, cancer or neoplasia cell numbers or mass, but over time eventual slowing, delay, stabilization or reduction in tumor, cancer or neoplasia cell mass, size or numbers of cells in a given subject may subsequently occur after cell lysis or apoptosis of the tumor, cancer or neoplasia, or metastasis.

Additional adverse symptoms and complications associated with tumor, cancer or neoplasia and metastasis that can be inhibited, reduced, decreased, delayed or prevented include, for example, nausea, lack of appetite, lethargy, pain and discomfort. Thus, a partial or complete decrease or reduction in the severity, duration or frequency of an adverse symptom or complication associated with or caused by a cell proliferative or a hyperproliferative disorder, an improvement in the subjects well being, such as increased energy, appetite, psychological well being, are all particular non-limiting examples of therapeutic benefit. A therapeutic benefit or improvement therefore can also include a subjective improvement in the quality of life of a treated subject.

In various embodiments, a method reduces or decreases tumor, cancer or neoplasia, or metastasis volume, cell numbers or proliferation, inhibits or prevents an increase in tumor, cancer or neoplasia volume, cell numbers or proliferation, inhibits or delays tumor, cancer or neoplasia progression or worsening, stimulates neoplasia, tumor or cancer, or metastasis cell lysis, apoptosis or differentiation, or inhibits, reduces, decreases or delays tumor, cancer or neoplasia proliferation, malignancy, growth or metastasis. In an additional embodiment, a method prolongs or extends lifespan of the subject. In a further embodiment, a method improves the quality of life of the subject.

Examination of a biopsied sample containing a tumor, cancer or neoplasia, or metastasis (e.g., blood or tissue sample), can establish tumor, cancer or neoplasia cell mass, volume or cell numbers, and therefore whether a reduction or stabilization in mass, volume or numbers of tumor, cancer or neoplasia cells or inhibition or delay of tumor, cancer or neoplasia cell proliferation, growth, malignancy, metastasis or survival (apoptosis) has occurred. For a solid tumor, cancer or neoplasia, invasive and non-invasive imaging methods can ascertain size, mass volume or cell numbers. Examination of blood or serum, for example, for populations, numbers and types of cells (e.g., hematopoetic cellular hyperproliferative disorders), grades or stages can establish whether a reduction or stabilization in mass, volume, numbers or the type, grade or stage of tumor, cancer or neoplasia cells or inhibition of tumor, cancer or neoplasia proliferation, growth, malignancy, metastasis or survival (apoptosis) has occurred.

Invention compounds and methods can be combined with any other treatment or therapy that provides a desired effect. In particular, treatments and therapies that have been characterized as having an anti-cell proliferative activity or function are applicable. Exemplary treatments and therapies include anti-cell proliferative or immune enhancing agents or drugs.

The treatments and therapies can be performed prior to, substantially contemporaneously with any other methods of the invention, for example, an anti-cell proliferative or anti-hyperproliferative disorder (e.g., a tumor, cancer or neoplasia, or metastasis).

The invention therefore provides combination methods, in which any of the compounds, and modified and variant forms, are used in a combination with any therapeutic regimen, treatment protocol or composition, such as an anti-cell proliferative protocol, agent or drug set forth herein or known in the art. In one embodiment, a method includes administering a compound having a conserved motif, and an anti-cell proliferative or immune enhancing treatment, agent or drug. The anti-cell proliferative or immune enhancing treatment, agent or drug can be administered prior to, substantially contemporaneously with or following administration of the compound.

As used herein, an "anti-cell proliferative," "anti-neoplastic," "anti-tumor," or "anti-cancer" treatment, therapy, activity or effect means any therapy, treatment regimen, agent, drug, protocol or process that is useful in treating pathologies, adverse symptoms or complications associated with or caused by abnormal or undesirable cell proliferation (hyperproliferation), a cellular hyperproliferative disorder, tumor, cancer or neoplasia, or metastasis. Particular therapies, treatment regimens, agents, drugs, protocol or processes can inhibit, decrease, slow, reduce, delay, or prevent cell proliferation, cell growth, hyperproliferation, tumor, cancer or neoplasia (malignant) growth, proliferation, survival, malignancy or metastasis. Such treatments, therapies, regimens, protocols, agents and drugs, can operate by disrupting, reducing, inhibiting or delaying cell cycle progression or cell proliferation or growth; increasing, stimulating or enhancing cell apoptosis, lysis, death or differentiation; inhibiting nucleic acid or protein synthesis or metabolism; reducing, decreasing, inhibiting or delaying cell division; or decreasing, reducing or inhibiting cell survival, or production or utilization of a cell survival factor, growth factor or signaling pathway (extracellular or intracellular).

Examples of anti-cell proliferative treatments and therapies include chemotherapy, immunotherapy, radiotherapy (ionizing or chemical), local or regional thermal (hyperthermia) therapy and surgical resection.

Specific non-limiting classes of anti-cell proliferative agents and drugs include alkylating agents, anti-metabolites, plant extracts, plant alkaloids, nitrosoureas, hormones (steroids), nucleoside and nucleotide analogues. Specific non-limiting examples of microbial toxins include bacterial cholera toxin, pertussis toxin, anthrax toxin, diphtheria toxin, and plant toxin ricin. Specific examples of drugs include cyclophosphamide, azathioprine, cyclosporin A, melphalan, chliorambucil, mechlorethamine, busulphan, methotrexate, 6-mercaptopurine, thioguanine, 5-fluorouracil, 5-fluorouridine, cytosine arabinoside, AZT, 5-azacytidine (5-AZC) and 5-azacytidine related compounds, bleomycin, actinomycin D, mithramycin, mitomycin C, carmustine, calicheamicin, lomustine, semustine, streptozotocin, teniposide, etoposide, hydroxyurea, cisplatin, carboplatin, levamisole, mitotane, procarbazine, dacarbazine, taxol, vinblastine, vincristine, vindesine, doxorubicin, daunomycin and dibromomannitol. Specific non-limiting examples of hormones include prednisone, prednisolone, diethylstilbesterol, flutamide, leuprolide, and gonatrophin releasing hormone antagonists.

Radiotherapy includes internal or external delivery to a subject. For example, alpha, beta, gamma and X-rays can administered to a subject externally without the subject internalizing or otherwise physically contacting the radioisotope. Specific examples of X-ray dosages range from daily doses of 50 to 200 roentgens for prolonged periods of time (3 to 5/week), to single doses of 2000 to 6000 roentgens. Dosages vary widely, and depend on duration of exposure, the half-life of the isotope, the type of radiation emitted, the cell type and location treated and the progressive stage of the disease. Specific non-limiting examples of radionuclides include, for example, $^{47}$Sc $^{67}$Cu, $^{72}$Se, $^{88}$Y, $^{90}$Sr, $^{90}$Y, $^{97}$Ru, $^{99}$Tc, $^{105}$Rh, $^{111}$In, $^{125}$I, $^{131}$I, $^{149}$Tb, $^{153}$Sm, $^{186}$Re, $^{188}$Re, $^{194}$Os, $^{203}$Pb, $^{211}$At, $^{212}$Bi, $^{213}$Bi, $^{212}$Pb, $^{223}$Ra, $^{225}$Ac, $^{227}$Ac, and $^{228}$Th.

Antibodies that bind to tumor, cancer or neoplasia cells are a particular example of an anti-cell proliferative treatment or therapy. Anti-tumor antibodies include, for example, M195 antibody which binds to leukemia cell CD33 antigen (U.S. Pat. No. 6,599,505); monoclonal antibody DS6 which binds to ovarian carcinoma CA6 tumor-associated antigen (U.S. Pat. No. 6,596,503); human IBD12 monoclonal antibody which binds to epithelial cell surface H antigen (U.S. Pat. No. 4,814,275); and BR96 antibody which binds to Le$^x$ carbohydrate epitope expressed by colon, breast, ovary, and lung carcinomas. Additional anti-tumor, cancer or neoplasia antibodies that can be employed include, for example, Herceptin (anti-Her-2 neu antibody), Rituxan®, Zevalin, Bevacizumab (Avastin), Bexxar, Campath®, Oncolym, 17-1A (Edrecolomab), 3F8 (anti-neuroblastoma antibody), MDX-CTLA4, IMC-C225 (Cetuximab) and Mylotarg.

As used here, the term "immune enhancing," when used in reference to a treatment, therapy, agent or drug means that the treatment, therapy, agent or drug provides an increase, stimulation, induction or promotion of an immune response, humoral or cell-mediated. Such therapies can enhance immune response generally, or enhance immune response to a specific target, e.g., a cell proliferative or cellular hyperproliferative disorder such as a tumor, cancer or neoplasia, or metastasis.

Specific non-limiting examples of immune enhancing agents include antibody, cell growth factors, cell survival factors, cell differentiative factors, cytokines and chemokines. Additional examples of immune enhancing agents and treatments include immune cells such as lymphocytes, plasma cells, macrophages, dendritic cells, NK cells and B-cells that either express antibody against the cell proliferative disorder or otherwise are likely to mount an immune response against a cell proliferative disorder (e.g., a tumor, cancer or neoplasia). Cytokines that enhance or stimulate immunogenicity include IL-2, IL-1α, IL-1β, IL-3, IL-6, IL-7, granulocyte-macrophage-colony stimulating factor (GMCSF), IFN-γ, IL-12, TNF-α, and TNFβ, which are also non-limiting examples of immune enhancing agents. Chemokines including MIP-1α, MIP-1β, RANTES, SDF-1, MCP-1, MCP-2, MCP-3, MCP-4, eotaxin, eotaxin-2, I-309/TCA3, ATAC, HCC-1, HCC-2, HCC-3, PARC, TARC, LARC/MIP-3α, CKβ, CKβ6, CKβ7, CKβ8, CKβ9, CKβ11, CKβ12, C10, IL-8, ENA-78, GROα, GROβ, GCP-2, PBP/CTAPIIIβ-TG/NAP-2, Mig, PBSF/SDF-1, and lymphotactin are further non-limiting examples of immune enhancing agents.

Methods of the invention also include, among other things, methods that result in a reduced need or use of another treatment protocol or therapeutic regimen, process or remedy. For example, for a tumor, cancer or neoplasia, or metastasis, a method of the invention has a therapeutic benefit if in a given subject it results in a less frequent or reduced dose or elimination of an anti-cell proliferative (e.g., anti-neoplastic, anti-tumor or anti-cancer) or immune enhancing treatment or therapy, such as a chemotherapeutic drug, radiotherapy, immunotherapy, or surgery for tumor, cancer or neoplasia, or metastasis treatment or therapy.

In accordance with the invention, methods of reducing need or use of an anti-cell proliferative (e.g., anti-neoplastic, anti-tumor, anti-cancer or anti-metastasis) treatment or therapy are provided. In various embodiments, a method includes administering to a subject a compound of the invention, in an amount effective to treat a cell proliferative disorder (e.g., a tumor, cancer or neoplasia, or metastasis), and to reduce or eliminate need for an anti-cell proliferative (anti-neoplasia, anti-tumor or anti-cancer, or anti-metastasis) or immune-enhancing therapy. The methods can be performed prior to, substantially contemporaneously with or following administration of an anti-tumor, cancer or neoplasia or metastasis, or immune-enhancing therapy.

The doses or "amount effective" or "amount sufficient" in a method of treatment or therapy is an amount in which there is a desired effect, such as a therapeutic benefit or improvement includes, for example, any objective or subjective alleviation or amelioration of one, several or all pathologies, adverse symptoms or complications associated with or caused by the target (e.g., cell proliferative disorder), to a measurable or detectable extent, although preventing, inhibiting or delaying a progression or worsening of the target (e.g., cell proliferative disorder) pathology, adverse symptom or complication, is a satisfactory outcome. Thus, in the case of a cell proliferative disorder, the amount will desirably be sufficient to provide a therapeutic benefit to a given subject or to alleviate or ameliorate a pathology, adverse symptom or complication of the proliferative disorder in a given subject. The dose may be proportionally increased or reduced as indicated by the status of treatment or the particular target (e.g., cell proliferative disorder) or any side effect(s) of the treatment or therapy.

Exemplary non-limiting amounts (doses) are in a range of about 0.1 mg/kg to about 100 mg/kg, and any numerical value or range or value within such ranges. Greater or lesser amounts (doses) can be administered, for example, 0.01-500 mg/kg, and any numerical value or range or value within such ranges. Additional exemplary non-limiting amounts (doses) range from about 0.5-50 mg/kg, 1.0-25 mg/kg, 1.0-10 mg/kg, and any numerical value or range or value within such ranges.

Methods of the invention may be practiced one or more times (e.g., 1-10, 1-5 or 1-3 times) per day, week, month, or year. The skilled artisan will know when it is appropriate to modify an administration regimen, such as to increase, or to reduce, delay or discontinue administration. An exemplary non-limiting dosage schedule is 1-7 times per week, for 1, 2, 3, 4, 5, 6, 7, 8, 9, 10, 15, 20 or more weeks, and any numerical value or range or value within such ranges.

Of course, as is typical for any treatment or therapy, different subjects will exhibit different responses to treatment and some may not respond or respond inadequately to a particular treatment protocol, regimen or process. Amounts effective or sufficient will therefore depend at least in part upon the disorder treated (e.g., cell proliferation, benign hyperplasia or a tumor, cancer or neoplasia and the type, grade or stage, e.g., the a tumor, cancer or neoplasia grade and if it is advanced, late or early stage), the therapeutic effect desired, as well as the individual subject (e.g., the bioavailability within the subject, gender, age, etc.) and the subject's response to the treatment based upon genetic and epigenetic variation (e.g., pharmacogenomics).

The terms "subject" and "patient" are used interchangeably herein and refer to animals, typically mammals, such as humans, non-human primates (gorilla, chimpanzee, orangutan, macaque, gibbon), domestic animals (dog and cat), farm and ranch animals (horse, cow, goat, sheep, pig), laboratory and experimental animals (mouse, rat, rabbit, guinea pig). Subjects include disease model animals (e.g., such as mice, rats and non-human primates) for studying in vivo efficacy (e.g., a tumor, cancer or neoplasia, or metastasis animal model). Human subjects include children, for example, newborns, infants, toddlers and teens, between the ages of 1 and 5, 5 and 10 and 10 and 18 years, young adults between the ages of 18 and 25, adults between 25 and 60 years, and the elderly, for example, between the ages of 60 and 65, 65 and 70 and 70 and 100 years.

Subjects include mammals (e.g., humans) in need of treatment, that is, they have undesirable or aberrant cell proliferation (cell hyperproliferation) or a cell proliferative disorder (e.g., a tumor, cancer or neoplasia, or metastasis). Subjects also include those at risk of having undesirable cell proliferation or a cell proliferative disorder. Subjects further include a subject in need of an anti-cell proliferative or immune enhancing treatment or therapy due to a clinical or lab diagnosis warranting such treatment, subjects undergoing an anti-cell proliferative or immune enhancing therapy, and subjects having undergone an anti-cell proliferative or immune enhancing therapy or treatment and are at risk of relapse or recurrence, including a subject that is in remission for a cell proliferative disorder (e.g., tumor, cancer or neoplasia) but who may be at risk of relapse.

At risk subjects include those with a family history, genetic predisposition, or who have suffered a previous affliction with a cell proliferative or hyperproliferative disorder (e.g., a benign hyperplasia, tumor, cancer or neoplasia, or metastasis), and are at risk of relapse or recurrence. At risk subjects further include environmental exposure to carcinogens or mutagens, such as smokers, or those in an occupational (industrial, chemical, agricultural) setting. Such subjects at risk for developing a cell proliferative or hyperproliferative disorder such as tumor, cancer or neoplasia can be identified with genetic screens for tumor associated genes, gene deletions or gene mutations. Subjects that lack Brca1 are at risk for developing breast cancer, for example. Subjects at risk for developing colon cancer have deleted or mutated tumor suppressor genes, such as adenomatous polyposis coli (APC), for example. At risk subjects having particular genetic predisposition towards cell proliferative disorders are known to the killed artisan (see, e.g., *The Genetic Basis of Human Cancer* $2^{nd}$ ed. by Bert Vogelstein (Editor), Kenneth W. Kinzler (Editor) (2002) McGraw-Hill Professional; *The Molecular Basis of Human Cancer*. Edited by W B Coleman and G J Tsongalis (2001) Humana Press; and *The Molecular Basis of Cancer*. Mendelsohn et al., WB Saunders (1995)).

At risk subjects can therefore be treated in order to inhibit or reduce the likelihood of developing a cell proliferative or hyperproliferative disorder, or after having been cured or treated for a cell proliferative disorder, suffering a relapse or recurrence of the same or a different cell proliferative or hyperproliferative disorder (e.g., a tumor, cancer or neoplasia). The result of such treatment can be to reduce the risk of developing a cell proliferative or hyperproliferative disorder, or to prevent a cell proliferative or hyperproliferative disorder, or a pathology, adverse symptom or complication thereof in the treated at risk subject.

The invention further provides kits, including compounds of the invention, modified and variants forms, and pharmaceutical formulations, packaged into suitable packaging material, optionally in combination with instructions for using the kit components, e.g., instructions for performing a method of the invention. In various embodiments, a kit includes a compound of the invention and instructions are for treating undesirable cell proliferation or hyperproliferation, or a hyperproliferative disorder. In one aspect, the instructions are for treating a tumor, cancer or neoplasia, or metastasis. In another aspect, a kit further includes an anti-cell proliferative or immune enhancing treatment, agent or drug. In particular aspects, a kit includes an anti-neoplastic, anti-cancer or anti-tumor agent. In still further aspects, a kit includes an article of manufacture, for example, an article of manufacture for delivering the compound, anti-cell proliferative or immune enhancing treatment, agent or drug into a subject at the site of the lesion, or locally, regionally or systemically.

The term "packaging material" refers to a physical structure housing the components of the kit. The packaging material can maintain the components sterilely, and can be made of material commonly used for such purposes (e.g., paper, corrugated fiber, glass, plastic, foil, ampules, etc.). The label or packaging insert can include appropriate written instructions, for example, practicing a method of the invention, e.g., treating a cell proliferative or hyperproliferative disorder, an assay for screening for, detecting or identifying a compound having anti-cell proliferative activity. Thus, in additional embodiments, a kit includes a label or packaging insert including instructions for practicing a method of the invention in solution, in vitro, in vivo, or ex vivo.

Instructions can therefore include instructions for practicing any of the methods of the invention described herein. For example, invention pharmaceutical compositions can be included in a container, pack, or dispenser together with instructions for administration to a subject to treat a cell proliferative or hyperproliferative disorder, such as a tumor, cancer or neoplasia, or metastasis. Instructions may additionally include indications of a satisfactory clinical endpoint or any adverse symptoms or complications that may occur, storage information, expiration date, or any information required by regulatory agencies such as the Food and Drug Administration for use in a human subject.

The instructions may be on "printed matter," e.g., on paper or cardboard within the kit, on a label affixed to the kit or packaging material, or attached to a vial or tube containing a component of the kit. Instructions may comprise voice or video tape and additionally be included on a computer readable medium, such as a disk (hard disk), optical CD such as CD- or DVD-ROM/RAM, magnetic tape, electrical storage media such as RAM and ROM and hybrids of these such as magnetic/optical storage media.

Invention kits can additionally include a buffering agent, a preservative, or a stabilizing agent. The kit can also include control components for assaying for activity, e.g., a control sample or a standard. Each component of the kit can be enclosed within an individual container or in a mixture and all of the various containers can be within single or multiple packages.

Compounds of the invention, and other compositions and methods of the invention can be included in or employ pharmaceutical formulations. Such pharmaceutical formulations are useful for treatment of, or administration or delivery to, a subject in vivo or ex vivo.

Pharmaceutical formulations include "pharmaceutically acceptable" and "physiologically acceptable" carriers, diluents or excipients. As used herein the terms "pharmaceutically acceptable" and "physiologically acceptable" include solvents (aqueous or non-aqueous), solutions, emulsions, dispersion media, coatings, isotonic and absorption promoting or delaying agents, compatible with pharmaceutical administration. Such formulations can be contained in a liquid; emulsion, suspension, syrup or elixir, or solid form; tablet (coated or uncoated), capsule (hard or soft), powder, granule, crystal, or microbead. Supplementary compounds (e.g., preservatives, antibacterial, antiviral and antifungal agents) can also be incorporated into the formulations.

Pharmaceutical formulations can be made to be compatible with a particular local, regional systemic, or tissue or organ system administration or delivery mode or route. Thus, pharmaceutical formulations include carriers, diluents, or excipients suitable for administration by particular routes. Specific non-limiting examples of routes of administration for compositions of the invention are parenteral, e.g., intravenous, intrarterial, intradermal, intramuscular, subcutaneous, intra-pleural, transdermal (topical), transmucosal, intra-cranial, intra-spinal, intra-ocular, rectal, oral (alimentary), mucosal administration, and any other formulation suitable for the treatment method or administration protocol.

Solutions or suspensions used for parenteral application can include: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide.

Pharmaceutical formulations for injection include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). The carrier can be a solvent or dispersion medium containing, for example, water, ethanol, polyol (for example, glycerol, propylene glycol, and liquid polyetheylene glycol, and the like), and suitable mixtures thereof. Fluidity can be maintained, for example, by the use of a coating such as lecithin, by the maintenance of the required particle size in the case of dispersion and by the use of surfactants. Antibacterial and antifungal agents include, for example, parabens, chlorobutanol, phenol, ascorbic acid and thimerosal. Isotonic agents, for example, sugars, polyalcohols such as mannitol, sorbitol, sodium chloride can be included in the composition. Including an agent which delays absorption, for example, aluminum monostearate or gelatin can prolong absorption of injectable compositions.

Sterile injectable formulations can be prepared by incorporating the active compound in the required amount in an appropriate solvent with one or a combination of above ingredients. Generally, dispersions are prepared by incorporating the active compound into a sterile vehicle containing a basic dispersion medium and any other ingredient. In the case of sterile powders for the preparation of sterile injectable solutions, methods of preparation include, for example, vacuum drying and freeze-drying which yields a powder of the active ingredient plus any additional desired ingredient from a previously prepared solution thereof.

For transmucosal or transdermal administration, penetrants appropriate to the barrier to be permeated are used in the formulation. Such penetrants are known in the art, and include, for example, for transmucosal administration, detergents, bile salts, and fusidic acid derivatives. Transmucosal administration can be accomplished through the use of nasal sprays, inhalation devices (e.g., aspirators) or suppositories. For transdermal administration, the active compounds are formulated into ointments, salves, gels, creams or patches.

The pharmaceutical formulations can be prepared with carriers that protect against rapid elimination from the body, such as a controlled release formulation or a time delay material such as glyceryl monostearate or glyceryl stearate. The formulations can also be delivered using articles of manufacture such as implants and microencapsulated delivery systems to achieve local, regional or systemic delivery or controlled or sustained release.

Biodegradable, biocompatible polymers can be used, such as ethylene vinyl acetate, polyanhydrides, polyglycolic acid, collagen, polyorthoesters, and polylactic acid. Methods for preparation of such formulations are known to those skilled in the art. The materials can also be obtained commercially from Alza Corporation (Palo Alto, Calif.). Liposomal suspensions (including liposomes targeted to cells or tissues using antibodies or viral coat proteins) can also be used as pharmaceutically acceptable carriers. These can be prepared according to known methods, for example, as described in U.S. Pat. No. 4,522,811.

Additional pharmaceutical formulations appropriate for administration are known in the art (see, e.g., Gennaro (ed.), *Remington: The Science and Practice of Pharmacy*, 20$^{th}$ ed., Lippincott, Williams & Wilkins (2000); Ansel et al., *Pharmaceutical Dosage Forms and Drug Delivery Systems*, 7$^{th}$ ed., Lippincott Williams & Wilkins Publishers (1999); Kibbe (ed.), *Handbook of Pharmaceutical Excipients American Pharmaceutical Association*, 3$^{rd}$ ed. (2000); and *Remington's Pharmaceutical Principles of Solid Dosage Forms*, Technonic Publishing Co., Inc., Lancaster, Pa., (1993)).

The compounds used in accordance with the invention, including pharmaceutical formulations can be packaged in dosage unit form for ease of administration and uniformity of dosage. "Dosage unit form" as used herein refers to physically discrete units suited as unitary dosages treatment; each unit contains a quantity of the compound in association with the carrier, excipient, diluent, or vehicle calculated to produce a desired treatment or therapeutic (e.g., beneficial) effect. The unit dosage forms will depend on a variety of factors including, but not necessarily limited to, the particular compound employed, the effect to be achieved, and the pharmacodynamics and pharmacogenomics of the subject to be treated.

In accordance with the invention, there are provided methods of identifying a compound having anti-cell proliferative activity, as well as methods for measuring anti-cell proliferative activity of a compound. In one embodiment, a method includes screening a compound for inhibition of cell proliferation (e.g., a tumor, cancer or neoplastic cell). A compound that is determined to inhibit cell proliferation is a compound having anti-cell proliferative activity. In another embodiment, a method includes screening a compound for binding to NPRC or activation of NPRC. A compound that is determined to bind to NPRC or activate NPRC is a compound having anti-cell proliferative activity.

In order to calculate, evaluate or identify a given compound for anti-cell proliferative activity or an amount of anti-cell proliferative activity, a variety of assays can be used. For example, cell toxicity and viability (cell apoptosis, lysis, growth proliferation, etc.) can be measured on the basis of colorimetric, luminescent, radiometric, or fluorometric assays known in the art. Colorimetric techniques, for example, Trypan Blue exclusion can be used to determine cell viability. In brief, cells are stained with Trypan Blue and counted using a hemocytometer. Viable cells exclude the dye whereas dead and dying cells take up the blue dye and are easily distinguished under a light microscope. Neutral Red is adsorbed by viable cells and concentrates in cell lysosomes; viable cells can be determined with a light microscope by quantitating numbers of Neutral Red stained cells.

Fluorometric techniques for determining cell viability include, for example, propidium iodide, a fluorescent DNA intercalating agent. Propidium iodide is excluded from viable cells but stains the nucleus of dead cells. Flow cytometry of propidium iodide labeled cells can then be used to quantitate viable and dead cells. Release of lactate dehydrogenase (LDH) indicates structural damage and death of cells, and can be measured by a spectrophotometric enzyme assay. Bromodeoxyuridine (BrdU) is incorporated into newly synthesized DNA and can be detected with a fluorochrome-labeled antibody. The fluorescent dye Hoechst 33258 labels DNA and can be used to quantitate proliferation of cells (e.g., flow cytometry). Quantitative incorporation of the fluorescent dye carboxyfluorescein diacetate succinimidyl ester (CFSE or CFDA-SE) can provide cell division analysis (e.g., flow cytometry). This technique can be used either in vitro or in vivo. 7-aminoactinomycin D (7-AAD) is a fluorescent intercalator that undergoes a spectral shift upon association with DNA, and can provide cell division analysis (e.g., flow cytometry).

Radiometric techniques for ascertaining cell proliferation include, for example, [$^3$H]-Thymidine, which is incorporated into newly synthesized DNA of living cells and frequently used to determine proliferation of cells. Chromium ($^{51}$Cr)-release from dead cells can be quantitated by scintillation counting in order to quantitate cell viability.

Luminescent techniques for determining cell viability include, for example, the CellTiter-Glo luminescent cell viability assay (Promega Madison Wis.). This technique quantifies the amount of ATP present to determine the number of viable cells.

Commercially available kits for determining cell viability and cell proliferation, and therefore the extent of anti-cell proliferative activity of a compound of the invention, include, for example, Cell Proliferation Biotrak ELISA (Amersham Biosciences Piscataway, N.J.); the Guava ViaCount™ Assay, which provides rapid cell counts and viability determination based on differential uptake of fluorescent reagents (Guava Technologies, Hayward, Calif.); the CyQUANT® Cell Proliferation Assay Kit (Molecular Probes, Inc., Eugene, Oreg.); and the CytoLux Assay Kit (PerkinElmer Life Sciences Inc., Boston, Mass.). The DEL-FIA® Assay Kits (PerkinElmer Life Sciences Inc., Boston, Mass.) can determine cell proliferation and viability using a time-resolved fluorometric method. The Quantos™ Cell Proliferation Assay is a fluorescence-based assay that measures the fluorescence of a DNA-dye complex from lysed cells (Stratagene, La Jolla, Calif.). The CellTiter-Glo cell viability assay is a luminescent assay for measuring cell viability (Promega, Madison Wis.).

The term "contacting," when used in reference to a composition such as a compound (e.g., a compound with a conserved motif having anti-cell proliferative activity), material, sample, or treatment, means a direct or indirect interaction between the compound and the other referenced entity. A particular example of direct interaction is binding. A particular example of an indirect interaction is where the compound acts upon an intermediary molecule, which in turn acts upon the referenced entity. Thus, for example, contacting a cell (e.g., that comprises a cell proliferative disorder) with a compound of the invention includes allowing the compound to bind to the cell, or allowing the compound to act upon an intermediary (e.g., receptor) that in turn acts upon the cell.

The invention also provides cell-free (e.g., in solution, in solid phase) and cell-based (e.g., in vitro or in vivo) methods of diagnosing a subject having or at increased probability of responding to treatment with an invention compound. In one embodiment, a method includes screening a subject for the presence of a cell (e.g., a cell of a cell proliferative disorder such as a neoplasia, tumor or cancer, or metastasis) that binds to the compound. The methods can be performed using a biological material or sample, for example, a biopsy of suspicious cells that may comprise or be indicative of neoplastic, tumor or cancer, or metastasis cells, tissue or organ. In one aspect, the biological material or sample is obtained from a mammalian subject (e.g., a human). The methods can also be performed in vivo, for example, in an animal.

Identifying, detecting, screening and diagnostic assays of the invention can be practiced by analysis of biological sample, such as suspect proliferating cells, for example, a cell of a cell proliferative disorder. Cells include hyperproliferating, immortalized, neoplastic, tumor and cancer cell lines and primary isolates derived from breast, lung, thyroid, head and neck, nasopharynx, nose or sinuses, brain, spine, adrenal gland, thyroid, lymph, gastrointestinal (mouth, esophagus, stomach, duodenum, ileum, jejunum (small intestine), colon, rectum), genito-urinary tract (uterus, ovary, cervix, bladder, testicle, penis, prostate), kidney, pancreas, adrenal gland, liver, bone, bone marrow, lymph, blood, muscle, skin, and the hematopoetic system, and metastasis or secondary sites.

The terms "assaying" and "measuring" and grammatical variations thereof are used interchangeably herein and refer to either qualitative or quantitative determinations, or both qualitative and quantitative determinations. When the terms are used in reference to activity (e.g., anti-cell proliferative or anticancer activity), any means of assessing the relative activity is contemplated, including the various methods set forth herein and known in the art.

In accordance with the invention, further provided are methods of producing compounds of the invention. In one embodiment, a method includes transforming a host cell with a nucleic acid encoding a compound and culturing the host cell under conditions that allow expression of the encoded compound, and optionally isolating or purifying the compound from the transformed cells.

Thus, there are also provided host cells that express compounds of the invention as set forth herein. In particular embodiments, a host cell transformed with a nucleic acid encoding a compound having a conserved motif which has anti-cell proliferative activity expresses the compound.

Unless otherwise defined, all technical and scientific terms used herein have the same meaning as commonly understood by one of ordinary skill in the art to which this invention relates. Although methods and materials similar or equivalent to those described herein can be used in the practice or testing of the invention, suitable methods and materials are described herein.

All publications, patents, Genbank accession numbers and other references cited herein are incorporated by reference in their entirety. In case of conflict, the present specification, including definitions, will control.

As used herein, singular forms "a", "and," and "the" include plural referents unless the context clearly indicates otherwise. Thus, for example, reference to a "compound" or a "peptide" or "mimetic" includes a plurality of compounds, peptides or mimetics, and reference to "a treatment or therapy" can include multiple simultaneous, consecutive or sequential treatments or therapies, and so forth.

As used herein, all numerical values or numerical ranges include whole integers within or encompassing such ranges and fractions of the values or the integers within or encompassing ranges unless the context clearly indicates otherwise. Thus, for example, reference to a range of 8 to 50, includes any numerical value or range within or encompassing such values, such as 8, 9, 10, 11, 12, 13, 14, 15, 16, 17, 18, 19, 20, 21, 22, 23, 24, 25, 26, 27, 28, 29, 30, etc.

The invention is generally disclosed herein using affirmative language to describe the numerous embodiments. The invention also specifically includes embodiments in which particular subject matter is excluded, in full or in part, such as substances or materials, method steps and conditions, protocols, procedures, assays or analysis. Thus, even though the invention is generally not expressed herein in terms of what the invention does not include, aspects that are not expressly included in the invention are nevertheless disclosed.

A number of embodiments of the invention have been described. Nevertheless, it will be understood that various modifications may be made without departing from the spirit and scope of the invention. Accordingly, the following examples are intended to illustrate but not limit the scope of invention described in the claims. For example, the following non-limiting examples include methods for ascertaining the anti-cell proliferative motif for activity, as well as describe a limited number of exemplary peptides and methods of use. These exemplary compositions and methods of treatment do not limit the invention, but provide general guidance to prepare and use the compounds, compositions and methods of the invention.

The studies herein should therefore not be construed as specifically limiting the invention and such variations of the invention, now known or later developed, which would be within the purview of one skilled in the art are considered to fall within the scope of the invention as described herein and hereinafter claimed. For example, in each case of an exemplary peptide shown below, a compound of the invention may be substituted for the exemplary peptide.

Trademarks used herein are examples only and reflect illustrative materials used at the time of the invention. The skilled artisan will recognize that variations in lot, manufacturing processes, and the like, are expected. Hence the examples, and the trademarks used in them are non-limiting, and they are not intended to be limiting, but are merely an illustration of how a skilled artisan may choose to perform one or more of the embodiments of the invention.

The Sequence Listing submitted herewith in computer readable form is incorporated herein by reference.

EXAMPLES

Example 1

This example describes a general method of producing peptides, proteins, fragments and mimetics that include an anti-cell proliferative (e.g., anticancer) motif.

Desired peptide fragments may be chemically synthesized. An alternative approach involves generating peptide fragments by enzymatic digestion, e.g., by treating the protein with an enzyme that cleaves proteins at sites defined by particular amino acid residues. Another alternative approach involves genetic methodology. Such techniques include expression of all or a part of the gene encoding the compound into a host cell such as mammalian cell, HeLa or Cos cells or *E. coli*. Such host cells can express full length or a fragment, for example, an scFv (see, e.g., Whitlow et al., In: *Methods: A Companion to Methods in Enzymology* 2:97 (1991), Bird et al., *Science* 242:423 (1988); and U.S. Pat. No. 4,946,778). For example, digesting a DNA encoding a peptide compound with a suitable restriction enzyme, and isolating the desired fragment and insert it into a vector for cell expression of the encoded peptide compound. Yet another suitable technique involves isolating and amplifying a DNA fragment encoding a desired polypeptide fragment, by polymerase chain reaction (PCR). Oligonucleotides that define the desired termini of the DNA fragment are employed at the 5' and 3' primers in the PCR.

In preparing a peptide, variations can be made using methods known in the art such as oligonucleotide-mediated (site-directed) mutagenesis, alanine scanning, and PCR mutagenesis. Site-directed mutagenesis [Carter et al., Nucl. Acids Res., 13:4331 (1986); Zoller et al., Nucl. Acids Res., 10:6487 (1987)], cassette mutagenesis [Wells et al., Gene, 34:315 (1985)], restriction selection mutagenesis [Wells et al., Philos. Trans. R. Soc. London SerA, 317:415 (1986)] or other known techniques can be performed on the cloned DNA to produce the variant DNA.

Example 2

This example describes data indicating that two exemplary peptides with a conserved motif have anticancer cell activity. This example also includes a description of an exemplary cell based assay for ascertaining anti-cell proliferative activity.

Human Pancreatic Adenocarcinoma Cells (HPAC) cells were obtained from ATCC and propagated in Dulbecco's modified Eagle's medium and Ham's F12 medium (DME-F12) (1:1) containing 2.5 mM glutamine, 2 mg/mL insulin, 5 ug/mL transferrin, 1 ng/mL EGF (epidermal growth factor), plus 5% FBS (fetal bovine serum). Cell cultures were incubated at 37° C., 5% $CO_2$ in a 100% humidity atmosphere. The cells were routinely brought to confluence in T-flasks, rinsed with phosphate buffered saline (PBS), and treated with trypsin for 5 min at room temp. The trypsinized cells were rinsed from the plate with 10 mL medium and counted. Viability at subculturing was generally ≥95%.

Approximately 10,000 cells in 100 uL of medium were placed in each well of a 96-well plate and incubated over night. Peptides having the following sequences were used: Arg-15-Cys (RSSCAGAALSPLGAC; SEQ. ID NO:122); Pro-15-Val (PNEEAGAALSPLPEV; SEQ. ID NO:121); Ala-8-Leu (AGAALSPL; SEQ. ID NO:85); C-ANP 4-23 (RSSCFGGRIDRIGAC; SEQ. ID NO:124) and, VDL (EV-VPPQVLSEPNEEAGAALSPLPEVPPWTGEVSPAQR; SEQ. ID NO:125). The peptides were dissolved in PBS and sterile filtered. The peptides were diluted into the cell culture medium to the following final concentrations: 1, 0.3, 0.1, 0.03, and 0.01 uM. Each peptide was tested in 5 replicate wells. The cultures were incubated for an additional 48 hours at 37° C.

Figure 2:
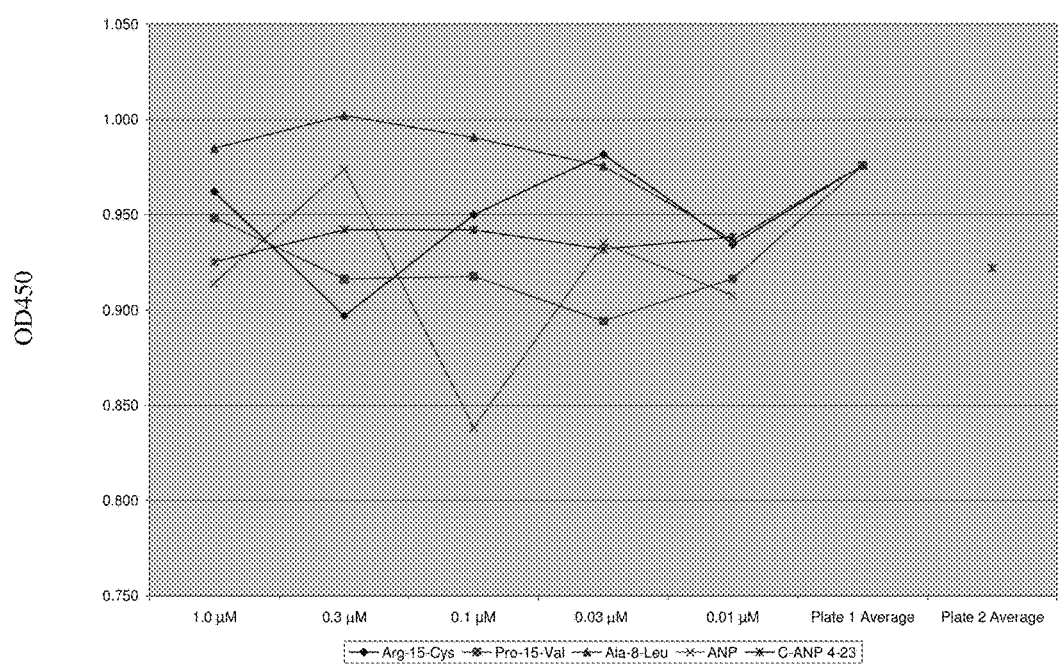
FIG. 2 is a graph showing antitumor activity of peptides: arg-15-cys, Pro-15-Val, Ala-8-Leu, VDL and C-ANP 4-23.

The viability of the cells was determined using a Calbiochem Rapid Cell Proliferation Kit (catalog number QIA127). Ten uL of Calbiochem color reagent was added to each well and incubated for an additional 1.5 hours at 37° C. Optical densities were read at 450 nm using a Molecular Devices ThermoMax microplate reader. The plate template is shown in Table I (unlabeled wells contained cells but no peptide and were used as blanks). Results are presented in Table I, and are graphically illustrated in FIGS. 1 and 2.

TABLE I

Sample Locations in 96-Well Plates

| | 1 | 2 | 3 | 4 | 5 | 6 | 7 | 8 | 9 | 10 | 11 | 12 |
|---|---|---|---|---|---|---|---|---|---|---|---|---|
| Plate 1 | | | | | | | | | | | | |
| A | Arg-15-Cys 1 | 0.3 | 0.1 | 0.03 | 0.01 | | | 0.01 | 0.03 | 0.1 | 0.3 | 1 |
| B | | 0.01 | 1 | 0.3 | 0.1 | 0.03 | 0.03 | 0.1 | 0.3 | 1 | 0.01 | |
| C | Pro-15-Val 0.03 | 0.1 | 0.3 | 1 | 0.01 | | | 0.01 | 1 | 0.1 | 0.3 | 0.03 |
| D | | 0.01 | 0.03 | 0.1 | 0.3 | 1 | 1 | 0.3 | 0.1 | 0.03 | 0.01 | |
| E | | Ala-8-Leu 0.01 | 0.3 | 0.1 | 0.03 | 1 | 1 | 0.3 | 0.1 | 0.03 | 0.01 | |
| F | 0.3 | 0.1 | 0.03 | 1 | 0.01 | | | 0.01 | 1 | 0.3 | 0.1 | 0.03 |
| G | | 0.01 | 1 | 0.03 | 0.1 | 0.3 | 0.03 | 0.1 | 0.3 | 1 | 0.01 | |
| H | | | | | | | | 0.01 | 0.03 | 0.1 | 0.3 | 1 |
| Plate 2 | | | | | | | | | | | | |
| A | ANP 1 | 0.3 | 0.1 | 0.03 | 0.01 | | | | | | | |
| B | | 0.01 | 1 | 0.3 | 0.1 | 0.03 | | | | | | |
| C | C-ANP 0.03 | 0.1 | 0.3 | 1 | 0.01 | | | | | | | |
| D | | 0.01 | 0.03 | 0.1 | 0.3 | 1 | 1 | 0.3 | 0.1 | 0.03 | 0.01 | |
| E | | 0.01 | 0.03 | 0.1 | 0.3 | 1 | 1 | 0.3 | 0.1 | 0.03 | 0.01 | |
| F | | | | | | | | 0.01 | 1 | 0.3 | 0.1 | 0.03 |
| G | | | | | | | 0.03 | 0.1 | 0.3 | 1 | 0.01 | |
| H | | | | | | | | 0.01 | 0.03 | 0.1 | 0.3 | 1 |

Numerical values indicate peptide micromolar concentrations

TABLE II

Optical Densities in 96 Well Plate

| | 1.0 µM | 0.3 µM | 0.1 µM | 0.03 µM | 0.01 µM | 0.0 µM | 0.0 µM |
|---|---|---|---|---|---|---|---|
| Arg-15-Cys | 1.155 | 0.988 | 1.016 | 1.093 | 0.974 | 1.029 | 0.866 |
| | 1.005 | 0.957 | 0.917 | 0.894 | 0.920 | 0.858 | 0.988 |
| | 0.787 | 0.668 | 0.801 | 0.789 | 0.863 | 1.135 | 1.033 |
| | 0.944 | 0.913 | 0.990 | 0.955 | 0.840 | 1.279 | 1.003 |
| | 0.919 | 0.959 | 1.025 | 1.178 | 1.075 | 1.255 | 0.881 |

TABLE II-continued

Optical Densities in 96_Well Plate

| | 1.0 μM | 0.3 μM | 0.1 μM | 0.03 μM | 0.01 μM | 0.0 μM | 0.0 μM |
|---|---|---|---|---|---|---|---|
| Average | 0.962 | 0.897 | 0.950 | 0.982 | 0.934 | 0.999 | 1.013 |
| Std dev | 0.134 | 0.131 | 0.093 | 0.155 | 0.094 | 1.050 | 0.854 |
| Pro-15-Val | 0.856 | 0.875 | 0.680 | 0.892 | 0.907 | 0.946 | 0.826 |
| | 0.752 | 0.817 | 0.895 | 0.765 | 0.905 | 0.922 | 0.971 |
| | 0.802 | 0.855 | 0.893 | 0.693 | 0.633 | 0.967 | 1.055 |
| | 1.083 | 1.024 | 1.156 | 1.151 | 1.209 | 0.804 | 0.871 |
| | 1.248 | 1.010 | 0.964 | 0.970 | 0.928 | 0.817 | 0.893 |
| Average | 0.948 | 0.916 | 0.918 | 0.894 | 0.916 | 0.966 | 0.774 |
| Std dev | 0.210 | 0.094 | 0.171 | 0.179 | 0.204 | 0.977 | 0.933 |
| Ala-8-Leu | 0.732 | 0.784 | 0.832 | 0.892 | 0.744 | 0.892 | 1.014 |
| | 1.216 | 0.802 | 1.006 | 0.937 | 0.878 | 0.962 | 0.873 |
| | 0.954 | 0.998 | 1.031 | 0.989 | 1.000 | 0.974 | 0.966 |
| | 0.834 | 1.357 | 0.910 | 0.921 | 0.892 | 0.847 | 1.010 |
| | 1.189 | 1.070 | 1.174 | 1.139 | 1.169 | 0.562 | 0.926 |
| Average | 0.985 | 1.002 | 0.991 | 0.976 | 0.937 | 0.941 | 0.897 |
| Std dev | 0.214 | 0.234 | 0.130 | 0.098 | 0.159 | 1.310 | 0.868 |
| | | | | | Plate 1 Avg. | 0.976 | 0.934 |
| | | | | | Std dev | 0.171 | 0.988 |
| ANP | 1.018 | 1.001 | 0.884 | 0.948 | 0.981 | | 0.965 |
| | 0.819 | 0.889 | 0.889 | 0.882 | 0.815 | | 0.820 |
| | 0.954 | 0.837 | 0.907 | 0.911 | 0.822 | | 0.878 |
| | 0.829 | 0.934 | 0.862 | 0.951 | 0.965 | | 0.945 |
| | 0.951 | 1.209 | 0.650 | 0.982 | 0.955 | | 1.005 |
| Average | 0.914 | 0.974 | 0.838 | 0.935 | 0.908 | | 0.932 |
| Std dev | 0.087 | 0.145 | 0.107 | 0.039 | 0.082 | | 0.922 |
| C-ANP | 0.865 | 0.840 | 0.758 | 0.905 | 0.877 | | 0.744 |
| | 0.925 | 0.928 | 1.027 | 0.882 | 0.971 | | 0.936 |
| | 0.900 | 1.035 | 0.983 | 0.981 | 0.953 | | 0.892 |
| | 0.955 | 0.975 | 0.960 | 0.948 | 0.932 | | 0.895 |
| | 0.981 | 0.932 | 0.982 | 0.943 | 0.958 | | 0.906 |
| Average | 0.925 | 0.942 | 0.942 | 0.932 | 0.938 | | 0.914 |
| Std dev | 0.045 | 0.071 | 0.106 | 0.039 | 0.037 | | 0.849 |
| | | | | | | | 0.836 |
| | | | | | | | 0.877 |
| | | | | | | | 0.828 |
| | | | | | | | 1.016 |
| | | | | | | | 0.909 |
| | | | | | | | 0.911 |
| | | | | | | | 1.015 |
| | | | | | | | 0.998 |
| | | | | | | | 0.964 |
| | | | | | Plate 2 Avg. | | 0.922 |
| | | | | | Std dev | | 0.071 |

Example 3

This example describes activity of peptides having a conserved motif and conserved amino acids predicted to be functional in the motif. (Table III). This example also describes additional exemplary peptide sequences having a conserved motif predicted to have anti-cell proliferative (e.g., anticancer) activity (Table IV).

TABLE III (SEQ. ID NOS: 126, 127, 125, 128, 129, 130, 124, 131, 121, 122, 132 and 85)

| Peptide | Anti-cancer Activity | 1 | 2 | 3 | 4 | 5 | 6 | 7 | 8 | 9 | 10 | 11 | 12 | 13 | 14 | 15 | 16 | 17 |
|---|---|---|---|---|---|---|---|---|---|---|---|---|---|---|---|---|---|---|
| ANP | + | | | | | | | | S | L | R | R | S | S | C | F | G | G |
| CNP | + | | | | | | | | | | | | | | | F | G | L |
| KT-220 (VDL) | + | E | V | V | P | P | Q | V | L | S | E | P | N | E | E | A | G | A |
| LANP | + | | | | | | | | | | | | | | | F | K | N |
| KP | + | | | | | | | | | | | | | | | L | K | S |
| BNP | − | | | | | | | | | | | | | | | F | G | K |
| C-ANP 4-23 | + | | | | | | | | | | R | S | S | C | F | G | G | |

TABLE III-continued

| Conserved Amino Acids Peptides | | | | | | | | | | | | F, A, L | G, K | N, S, G, L, A | | | | | |
|---|---|---|---|---|---|---|---|---|---|---|---|---|---|---|---|---|---|---|
| Pro-15-Val | + | | | | | | | P | N | E | E | A | | G | A | | | |
| Arg-15-Cys | + | | | | | | | R | S | S | C | A | | G | A | | | |
| 3 | N/D | | | | | | | R | S | S | C | A | | G | K | | | |
| Ala-8-Leu | | | | | | | | | | | | A | | G | A | | | |

| | 18 | 19 | 20 | 21 | 22 | 23 | 24 | 25 | 26 | 27 | 28 | 29 | 30 | 31 | 32 | 33 | 34 | 35 | 36 | 37 |
|---|---|---|---|---|---|---|---|---|---|---|---|---|---|---|---|---|---|---|---|---|
| Peptide | | | | | | | | | | | | | | | | | | | | |
| ANP | R | M | D | R | I | G | A | Q | S | G | L | G | C | N | S | F | R | Y | | |
| CNP | K | L | D | R | I | | | | | | | | | | | | | | | |
| KT-220 (VDL) | A | L | S | P | L | P | E | V | P | P | W | T | G | E | V | S | P | A | Q | R |
| LANP | L | L | D | H | L | | | | | | | | | | | | | | | |
| KP | K | L | R | A | L | | | | | | | | | | | | | | | |
| BNP | R | M | D | R | I | | | | | | | | | | | | | | | |
| C-ANP 4-23 | R | I | D | R | I | G | A | C | | | | | | | | | | | | |
| Conserved Amino Acids Peptides | Any | L, M | S, D, R | Any | I, L | | | | | | | | | | | | | | | |
| Pro-15-Val | A | L | S | P | L | P | E | V | | | | | | | | | | | | |
| Arg-15-Cys | A | L | S | P | L | G | A | C | | | | | | | | | | | | |
| 3 | A | L | S | P | L | G | A | C | | | | | | | | | | | | |
| Ala-8-Leu | A | L | S | P | L | | | | | | | | | | | | | | | |

Positions 15 to 21 in Table III correspond to Res1-Res8 of the conserved motif. Conserved amino acids at each of Residues 1-8 include, for example, the following: (15) F, A, L; (16) G, K; (17) N, S, G, L, A; (18) Any; (19) L, M; (20) S, D, R; (21) Any; (22) I, L. Conserved amino acids at each of Residues 1-8 include, for example, Res1: a hydrophobic, non-polar, non-ionizable residue; Res2 a non-hydrophobic (amphiphillic or hydrophilic) residue; Res3, a non-ionizable residue or a residue with a small side chain (0-2 carbon backbone, with 3 and 4 carbons weaker); Res4, Any residue; Res5, a hydrophobic, non-polar, non-ionizable or aliphatic residue; Res6, a polar residue; Res7, Any residue; and Res8, a hydrophobic, non-polar, non-ionizable or aliphatic residue.

Notations "Res 1, Res 2" etc., herein refer by single letter abbreviation the amino acid in the exemplary peptide 8-mer. "Activity" can be determined by a cell proliferative assay, such as an assay described herein or known to one of skill in the art. Of course, peptides exemplified in Table IV can include the conserved motif peptide as part of a larger protein. The SEQ ID NO is the same as the peptide number.

TABLE IV

| SEQ ID NO | Res 1 | Res 2 | Res 3 | Res 4 | Res 5 | Res 6 | Res 7 | Res 8 | Predicted Activity |
|---|---|---|---|---|---|---|---|---|---|
| 1 | F | G | N | A | L | S | P | I | + |
| 2 | F | G | S | R | L | D | S | I | + |
| 3 | F | G | G | N | L | R | T | I | + |
| 4 | F | G | L | D | L | D | W | I | + |
| 5 | F | G | A | C | L | R | Y | I | + |
| 6 | F | G | N | E | M | S | V | I | + |
| 7 | F | G | S | Q | M | D | A | I | + |
| 8 | F | G | G | G | M | R | R | I | + |
| 9 | F | G | L | H | M | S | N | I | + |
| 10 | F | G | A | I | M | D | D | I | + |
| 11 | F | K | N | L | L | R | C | I | + |
| 12 | F | K | S | K | L | S | E | I | + |
| 13 | F | K | G | M | L | D | Q | I | + |
| 14 | F | K | L | G | L | R | G | I | + |
| 15 | F | K | A | F | L | S | H | I | + |
| 16 | F | K | N | P | M | D | I | I | + |
| 17 | F | K | S | S | M | R | L | I | + |
| 18 | F | K | G | T | M | S | K | I | + |
| 19 | F | K | L | W | M | D | M | I | + |
| 20 | F | K | A | Y | M | R | G | I | + |
| 21 | A | G | N | V | L | S | F | I | + |
| 22 | A | G | S | A | L | D | P | I | + |
| 23 | A | G | G | R | L | R | S | I | + |
| 24 | A | G | L | N | L | S | T | I | + |
| 25 | A | G | A | D | L | D | W | I | + |
| 26 | A | G | N | C | M | R | Y | I | + |
| 27 | A | G | S | E | M | S | V | I | + |
| 28 | A | G | G | Q | M | D | A | I | + |
| 29 | A | G | L | G | M | R | R | I | + |
| 30 | A | G | A | H | M | S | N | I | + |
| 31 | A | K | N | I | L | D | D | I | + |
| 32 | A | K | S | L | L | R | C | I | + |
| 33 | A | K | G | K | L | S | E | I | + |
| 34 | A | K | L | M | L | D | Q | I | + |
| 35 | A | K | A | G | L | R | G | I | + |
| 36 | A | K | N | F | M | S | H | I | + |
| 37 | A | K | S | P | M | D | I | I | + |
| 38 | A | K | G | S | M | R | L | I | + |
| 39 | A | K | L | T | M | S | K | I | + |
| 40 | A | K | A | W | M | D | M | I | + |
| 41 | L | G | N | Y | L | R | G | I | + |
| 42 | L | G | S | V | L | S | F | I | + |
| 43 | L | G | G | A | L | D | P | I | + |
| 44 | L | G | L | R | L | R | S | I | + |
| 45 | L | G | A | N | L | S | T | I | + |
| 46 | L | G | N | D | M | D | W | I | + |
| 47 | L | G | S | C | M | R | Y | I | + |
| 48 | L | G | G | E | M | S | V | I | + |
| 49 | L | G | L | Q | M | D | A | I | + |
| 50 | L | G | A | G | M | R | R | I | + |

TABLE IV-continued

| SEQ ID NO | Res 1 | Res 2 | Res 3 | Res 4 | Res 5 | Res 6 | Res 7 | Res 8 | Predicted Activity |
|---|---|---|---|---|---|---|---|---|---|
| 51 | L | K | N | H | L | S | N | I | + |
| 52 | L | K | S | I | L | D | D | I | + |
| 53 | L | K | G | L | L | R | C | I | + |
| 54 | L | K | L | K | L | S | E | I | + |
| 55 | L | K | A | M | L | D | Q | I | + |
| 56 | L | K | N | G | M | R | G | I | + |
| 57 | L | K | S | F | M | S | H | I | + |
| 58 | L | K | G | P | M | D | I | I | + |
| 59 | L | K | L | S | M | R | L | L | + |
| 60 | L | K | A | T | M | S | K | L | + |
| 61 | F | G | N | W | L | S | M | L | + |
| 62 | F | G | S | Y | L | D | G | L | + |
| 63 | F | G | G | V | L | R | F | L | + |
| 64 | F | G | L | A | L | D | P | L | + |
| 65 | F | G | A | R | L | R | S | L | + |
| 66 | F | G | N | N | M | S | T | L | + |
| 67 | F | G | S | D | M | D | W | L | + |
| 68 | F | G | G | R | M | D | R | I | + |
| 69 | F | G | L | E | M | S | V | L | + |
| 70 | F | G | A | Q | M | D | A | L | + |
| 71 | F | K | N | G | L | R | R | L | + |
| 72 | F | K | S | H | L | S | N | L | + |
| 73 | F | K | G | I | L | D | D | L | + |
| 74 | F | K | L | L | L | R | C | L | + |
| 75 | F | K | A | K | L | S | E | L | + |
| 76 | F | K | N | M | M | D | Q | L | + |
| 77 | F | K | S | G | M | R | G | L | + |
| 78 | F | K | G | F | M | S | H | L | + |
| 79 | F | K | L | P | M | D | I | L | + |
| 80 | F | K | A | S | M | R | L | L | + |
| 81 | A | G | N | T | L | S | K | L | + |
| 82 | A | G | S | W | L | D | M | L | + |
| 83 | A | G | G | Y | L | R | G | L | + |
| 84 | A | G | L | V | L | S | F | L | + |
| 85 | A | G | A | A | L | S | P | L | + |
| 86 | A | G | N | R | M | R | S | L | + |
| 87 | A | G | S | N | M | S | T | L | + |
| 88 | A | G | G | D | M | D | W | L | + |
| 89 | A | G | L | C | M | R | Y | L | + |
| 90 | A | G | A | E | M | S | V | L | + |
| 91 | A | K | N | Q | L | D | A | L | + |
| 92 | A | K | S | G | L | R | R | L | + |
| 92 | A | K | G | H | L | S | N | L | + |
| 94 | A | K | L | I | L | D | D | L | + |
| 95 | A | K | A | L | L | R | C | L | + |
| 96 | A | K | N | K | M | S | E | L | + |
| 97 | A | K | S | M | M | D | Q | L | + |
| 98 | A | K | G | G | M | R | G | L | + |
| 99 | A | K | L | F | M | S | H | L | + |
| 100 | A | K | A | P | M | D | I | L | + |
| 101 | L | G | N | S | L | R | L | L | + |
| 102 | L | G | S | T | L | S | K | L | + |
| 103 | L | G | G | W | L | D | M | L | + |
| 104 | L | G | L | Y | L | R | G | L | + |
| 105 | L | G | A | V | L | S | F | L | + |
| 106 | L | G | N | A | M | D | P | L | + |
| 107 | L | G | S | R | M | R | S | L | + |
| 108 | L | G | G | N | M | S | T | L | + |
| 109 | L | G | L | D | M | D | W | L | + |
| 110 | L | G | A | C | M | R | Y | L | + |
| 111 | L | K | N | E | L | S | V | L | + |
| 112 | L | K | S | Q | L | D | A | L | + |
| 113 | L | K | G | G | L | R | R | L | + |
| 114 | L | K | L | H | L | S | N | L | + |
| 115 | L | K | A | I | L | D | D | L | + |
| 116 | L | K | N | L | M | R | C | L | + |
| 117 | L | K | S | K | M | S | E | L | + |
| 118 | L | K | G | M | M | D | Q | L | + |
| 119 | L | K | L | G | M | R | G | L | + |
| 120 | L | K | A | F | M | S | H | L | + |

Each of these exemplary peptides can be analyzed in vitro, ex vivo, and in vivo for anti-cell proliferative activity using an assay, such as a cell based in vitro assay described in Examples 1 or 4.

Example 4

This example includes a description of another exemplary cell based assay to determine anti-cell proliferative activity.

Human ovarian carcinoma cells are cultured, and the peptides tested according to methods previously described [Vesely, et al, Cancer Ther. 5:97-104 (2007)]. To investigate whether the peptides inhibit DNA synthesis, and indication of cell proliferation, bromodeoxyuridine (BrdU) incorporation into the human ovarian carcinoma cells was utilized as previously described. [Vesely, D. L. Eur J Clin Invest. 38(8) 562:(2008) and references therein). BrdU was from BD Bioscience, San Jose, Calif. After 24 hours in culture with 1 µM of vessel dilator VDL, or with no peptide hormone (i.e., control), BrdU in a final concentration of 10 µM in the cell culture medium was added for 45 minutes, which is the time in which the cells are in the logarithmic phase of cell proliferation. In addition, if the addition of the peptide of the invention significantly decreased the number of ovarian cancer cells in 24 hours, compared to the control.

Example 5

This example includes a description of testing of ANPs for anti-cell proliferative activity using NPR affinity as a proxy.

Although not wishing to be bound by theory, the relative potencies (anti-cell proliferative activity) of NP's are predicted to be related to binding affinities at NPRs [Vesely, D. L., Eur J Clin Invest. 38(8) 562:(2008) and references therein]. For example, the greater potency observed for ANP than CNP correlates with ANP's higher binding affinities at NPRA and NPRC, whereas the greater potency of CNP than BNP agrees with CNP having a higher binding affinity than BNP specifically at NPRC [Vesely, D. L., Eur J Clin Invest. 38(8) 562:(2008) and references therein].

The receptor selectivity of the natriuretic peptide family (ANP, BNP, CNP) using the homologous assay system described by Suga, et al., Endocrinol. 130:229-239 (1992). The rank order of binding affinity for the C-receptor follow the trends of the cell based assay of Example 4.

Thus, binding affinities at NPRs, such as NPRC may be a good proxy for anti-cell proliferative (anticancer) activity.

Example 6

This example includes a description of peptidomimetics having the conserved motif.

Literature compounds, which appear to be peptidomimetics of the anti-cell proliferative (e.g., anticancer) motif are assayed for activity (e.g., Examples 1 and 4) or are assayed for NPR binding (e.g., Example 5), and demonstrate binding. Predicted peptidomimetics include:

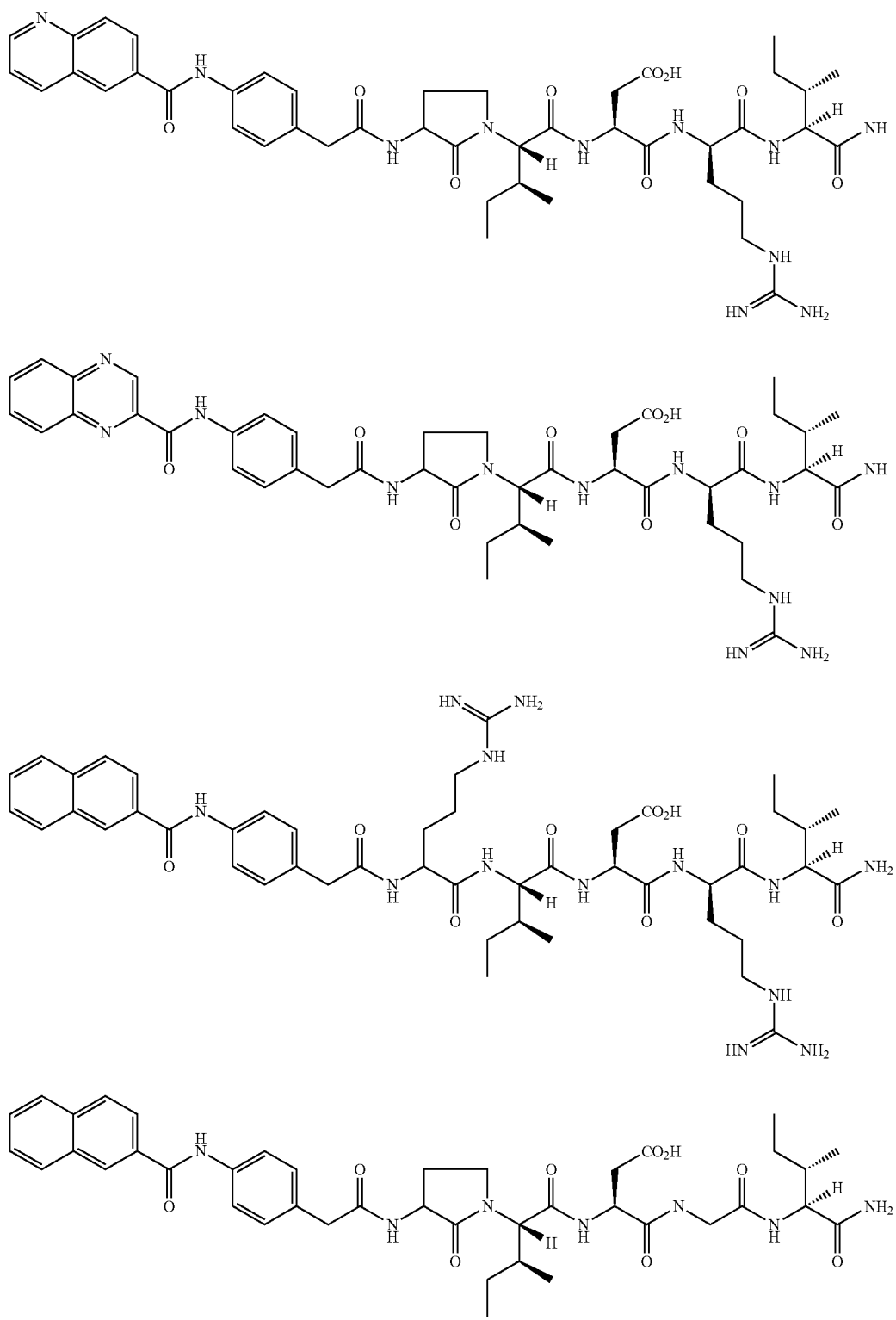

Example 7

This example includes a description of testing with an in vivo Xenograft model.

The efficacy in a xenograft model, of the natriuretic peptide family (CNP, VDL, LANP, KP, BNP), can employ the assay described by Vesely, D. L., In Vivo 21:445 (2007) in order to demonstrate anticancer activity.

Example 8

This example includes a description of various acceptable routes of systemic, regional or local, administration.

For administration by injection, an injectable solution can be prepared by conventional methods using 10.0 ml of physiological saline solution and 7.0 mg of a peptide adjusted to pH=7.4. One injection, one time daily for 4 days, can be administered to patients weighing approximately 70 kilogram.

For administration by infusion, an intravenous infusion composition can be prepared by conventional methods using 1000.0 ml of physiological saline solution and 400.0 mg of the peptide of Example 1 adjusted to pH=7.4. A one hour infusion, one time daily for 4 weeks, can be administered to a patient weighing approximately 58 kilograms.

For continuous administration, such as administration by Subcutaneous Injection via a pump, an injectable solution can be prepared by conventional methods using 1000.0 ml of physiological saline solution and 400.0 mg of a peptide adjusted to pH=7.4. The patient has a pump implanted to dispense the composition over time, as described in Vesely, D. L., In vivo 21:445-452 (2007). The implanted continuous infusion pump dispenses the composition at intervals, thrice daily for up to 8 weeks, to a patient weighing approximately 47 kilograms.

SEQUENCE LISTING (1911 sequences)

SEQ ID NO: 1 - protein, 8 aa, Artificial Sequence
  Description of Artificial Sequence: Synthetic Peptide
FGNALSPI

SEQ ID NO: 2 - protein, 8 aa, Artificial Sequence
  Description of Artificial Sequence: Synthetic Peptide
FGSRLDSI

SEQ ID NO: 3 - protein, 8 aa, Artificial Sequence
  Description of Artificial Sequence: Synthetic Peptide
FGGNLRTI

SEQ ID NO: 4 - protein, 8 aa, Artificial Sequence
  Description of Artificial Sequence: Synthetic Peptide
FGLDLDWI

SEQ ID NO: 5 - protein, 8 aa, Artificial Sequence
  Description of Artificial Sequence: Synthetic Peptide
FGACLRYI

SEQ ID NO: 6 - protein, 8 aa, Artificial Sequence
  Description of Artificial Sequence: Synthetic Peptide
FGNEMSVI

SEQ ID NO: 7 - protein, 8 aa, Artificial Sequence
  Description of Artificial Sequence: Synthetic Peptide
FGSQMDAI

SEQ ID NO: 8 - protein, 8 aa, Artificial Sequence
  Description of Artificial Sequence: Synthetic Peptide
FGGGMRRI

SEQ ID NO: 9 - protein, 8 aa, Artificial Sequence
  Description of Artificial Sequence: Synthetic Peptide
FGLHMSNI

SEQ ID NO: 10 - protein, 8 aa, Artificial Sequence
  Description of Artificial Sequence: Synthetic Peptide
FGAIMDDI

SEQ ID NO: 11 - protein, 8 aa, Artificial Sequence
  Description of Artificial Sequence: Synthetic Peptide
FKNLLRCI

SEQ ID NO: 12 - protein, 8 aa, Artificial Sequence
  Description of Artificial Sequence: Synthetic Peptide
FKSKLSEI

SEQ ID NO: 13 - protein, 8 aa, Artificial Sequence
  Description of Artificial Sequence: Synthetic Peptide
FKGMLDQI

SEQ ID NO: 14 - protein, 8 aa, Artificial Sequence
  Description of Artificial Sequence: Synthetic Peptide
FKLGLRGI

SEQ ID NO: 15 - protein, 8 aa, Artificial Sequence
  Description of Artificial Sequence: Synthetic Peptide
FKAFLSHI

SEQ ID NO: 16 - protein, 8 aa, Artificial Sequence
  Description of Artificial Sequence: Synthetic Peptide
FKNPMDII

SEQ ID NO: 17 - protein, 8 aa, Artificial Sequence
  Description of Artificial Sequence: Synthetic Peptide
FKSSMRLI

SEQ ID NO: 18 - protein, 8 aa, Artificial Sequence
  Description of Artificial Sequence: Synthetic Peptide
FKGTMSKI

SEQ ID NO: 19 - protein, 8 aa, Artificial Sequence
  Description of Artificial Sequence: Synthetic Peptide
FKLWMDMI

SEQ ID NO: 20 - protein, 8 aa, Artificial Sequence
  Description of Artificial Sequence: Synthetic Peptide
FKAYMRGI

SEQ ID NO: 21 - protein, 8 aa, Artificial Sequence
  Description of Artificial Sequence: Synthetic Peptide
AGNVLSFI

SEQ ID NO: 22 - protein, 8 aa, Artificial Sequence
  Description of Artificial Sequence: Synthetic Peptide
AGSALDPI

SEQ ID NO: 23 - protein, 8 aa, Artificial Sequence
  Description of Artificial Sequence: Synthetic Peptide
AGGRLRSI

SEQ ID NO: 24 - protein, 8 aa, Artificial Sequence
  Description of Artificial Sequence: Synthetic Peptide
AGLNLSTI

SEQ ID NO: 25 - protein, 8 aa, Artificial Sequence
  Description of Artificial Sequence: Synthetic Peptide
AGADLDWI

SEQ ID NO: 26 - protein, 8 aa, Artificial Sequence
  Description of Artificial Sequence: Synthetic Peptide
AGNCMRYI

SEQ ID NO: 27 - protein, 8 aa, Artificial Sequence
  Description of Artificial Sequence: Synthetic Peptide
AGSEMSVI

SEQ ID NO: 28 - protein, 8 aa, Artificial Sequence
  Description of Artificial Sequence: Synthetic Peptide
AGGQMDAI

SEQ ID NO: 29 - protein, 8 aa, Artificial Sequence
  Description of Artificial Sequence: Synthetic Peptide
AGLGMRRI

SEQ ID NO: 30 - protein, 8 aa, Artificial Sequence
  Description of Artificial Sequence: Synthetic Peptide
AGAHMSNI

SEQ ID NO: 31 - protein, 8 aa, Artificial Sequence
  Description of Artificial Sequence: Synthetic Peptide
AKNILDDI

SEQ ID NO: 32 - protein, 8 aa, Artificial Sequence
  Description of Artificial Sequence: Synthetic Peptide
AKSLLRCI

SEQ ID NO: 33 - protein, 8 aa, Artificial Sequence
  Description of Artificial Sequence: Synthetic Peptide
AKGKLSEI

SEQ ID NO: 34 - protein, 8 aa, Artificial Sequence
  Description of Artificial Sequence: Synthetic Peptide
AKLMLDQI

SEQ ID NO: 35 - protein, 8 aa, Artificial Sequence
  Description of Artificial Sequence: Synthetic Peptide
AKAGLRGI

SEQ ID NO: 36 - protein, 8 aa, Artificial Sequence
  Description of Artificial Sequence: Synthetic Peptide
AKNFMSHI

SEQ ID NO: 37 - protein, 8 aa, Artificial Sequence
  Description of Artificial Sequence: Synthetic Peptide
AKSPMDII

SEQ ID NO: 38 - protein, 8 aa, Artificial Sequence
  Description of Artificial Sequence: Synthetic Peptide
AKGSMRLI

SEQ ID NO: 39 - protein, 8 aa, Artificial Sequence
  Description of Artificial Sequence: Synthetic Peptide
AKLTMSKI

SEQ ID NO: 40 - protein, 8 aa, Artificial Sequence
  Description of Artificial Sequence: Synthetic Peptide
AKAWMDMI

SEQ ID NO: 41 - protein, 8 aa, Artificial Sequence
  Description of Artificial Sequence: Synthetic Peptide
LGNYLRGI

SEQ ID NO: 42 - protein, 8 aa, Artificial Sequence
  Description of Artificial Sequence: Synthetic Peptide
LGSVLSFI

SEQ ID NO: 43 - protein, 8 aa, Artificial Sequence
  Description of Artificial Sequence: Synthetic Peptide
LGGALDPI

SEQ ID NO: 44 - protein, 8 aa, Artificial Sequence
  Description of Artificial Sequence: Synthetic Peptide
LGLRLRSI

SEQ ID NO: 45 - protein, 8 aa, Artificial Sequence
  Description of Artificial Sequence: Synthetic Peptide
LGANLSTI

SEQ ID NO: 46 - protein, 8 aa, Artificial Sequence
  Description of Artificial Sequence: Synthetic Peptide
LGNDMDWI

SEQ ID NO: 47 - protein, 8 aa, Artificial Sequence
  Description of Artificial Sequence: Synthetic Peptide
LGSCMRYI

SEQ ID NO: 48 - protein, 8 aa, Artificial Sequence
  Description of Artificial Sequence: Synthetic Peptide
LGGEMSVI

SEQ ID NO: 49 - protein, 8 aa, Artificial Sequence
  Description of Artificial Sequence: Synthetic Peptide
LGLQMDAI

SEQ ID NO: 50 - protein, 8 aa, Artificial Sequence
  Description of Artificial Sequence: Synthetic Peptide
LGAGMRRI

SEQ ID NO: 51 - protein, 8 aa, Artificial Sequence
  Description of Artificial Sequence: Synthetic Peptide
LKNHLSNI

SEQ ID NO: 52 - protein, 8 aa, Artificial Sequence
  Description of Artificial Sequence: Synthetic Peptide
LKSILDDI

SEQ ID NO: 53 - protein, 8 aa, Artificial Sequence
  Description of Artificial Sequence: Synthetic Peptide
LKGLLRCI

SEQ ID NO: 54 - protein, 8 aa, Artificial Sequence
  Description of Artificial Sequence: Synthetic Peptide
LKLKLSEI

SEQ ID NO: 55 - protein, 8 aa, Artificial Sequence
  Description of Artificial Sequence: Synthetic Peptide
LKAMLDQI

SEQ ID NO: 56 - protein, 8 aa, Artificial Sequence
  Description of Artificial Sequence: Synthetic Peptide
LKNGMRGI

SEQ ID NO: 57 - protein, 8 aa, Artificial Sequence
  Description of Artificial Sequence: Synthetic Peptide
LKSFMSHI

SEQ ID NO: 58 - protein, 8 aa, Artificial Sequence
  Description of Artificial Sequence: Synthetic Peptide
LKGPMDII

SEQ ID NO: 59 - protein, 8 aa, Artificial Sequence
  Description of Artificial Sequence: Synthetic Peptide
LKLSMRLL

SEQ ID NO: 60 - protein, 8 aa, Artificial Sequence
  Description of Artificial Sequence: Synthetic Peptide
LKATMSKL

SEQ ID NO: 61 - protein, 8 aa, Artificial Sequence
  Description of Artificial Sequence: Synthetic Peptide
FGNWLSML

SEQ ID NO: 62 - protein, 8 aa, Artificial Sequence
  Description of Artificial Sequence: Synthetic Peptide
FGSYLDGL

SEQ ID NO: 63 - protein, 8 aa, Artificial Sequence
  Description of Artificial Sequence: Synthetic Peptide
FGGVLRFL

SEQ ID NO: 64 - protein, 8 aa, Artificial Sequence
  Description of Artificial Sequence: Synthetic Peptide
FGLALDPL

SEQ ID NO: 65 - protein, 8 aa, Artificial Sequence
  Description of Artificial Sequence: Synthetic Peptide
FGARLRSL

SEQ ID NO: 66 - protein, 8 aa, Artificial Sequence
  Description of Artificial Sequence: Synthetic Peptide
FGNNMSTL

SEQ ID NO: 67 - protein, 8 aa, Artificial Sequence
  Description of Artificial Sequence: Synthetic Peptide
FGSDMDWL

SEQ ID NO: 68 - protein, 8 aa, Artificial Sequence
  Description of Artificial Sequence: Synthetic Peptide
FGGRMDRI

SEQ ID NO: 69 - protein, 8 aa, Artificial Sequence
  Description of Artificial Sequence: Synthetic Peptide
FGLEMSVL

SEQ ID NO: 70 - protein, 8 aa, Artificial Sequence
  Description of Artificial Sequence: Synthetic Peptide
FGAQMDAL

SEQ ID NO: 71 - protein, 8 aa, Artificial Sequence
  Description of Artificial Sequence: Synthetic Peptide
FKNGLRRL

SEQ ID NO: 72 - protein, 8 aa, Artificial Sequence
  Description of Artificial Sequence: Synthetic Peptide
FKSHLSNL

SEQ ID NO: 73 - protein, 8 aa, Artificial Sequence
  Description of Artificial Sequence: Synthetic Peptide
FKGILDDL

SEQ ID NO: 74 - protein, 8 aa, Artificial Sequence
  Description of Artificial Sequence: Synthetic Peptide
FKLLLRCL

SEQ ID NO: 75 - protein, 8 aa, Artificial Sequence
  Description of Artificial Sequence: Synthetic Peptide
FKAKLSEL

SEQ ID NO: 76 - protein, 8 aa, Artificial Sequence
  Description of Artificial Sequence: Synthetic Peptide
FKNMMDQL

SEQ ID NO: 77 - protein, 8 aa, Artificial Sequence
  Description of Artificial Sequence: Synthetic Peptide
FKSGMRGL

SEQ ID NO: 78 - protein, 8 aa, Artificial Sequence
  Description of Artificial Sequence: Synthetic Peptide
FKGFMSHL

SEQ ID NO: 79 - protein, 8 aa, Artificial Sequence
  Description of Artificial Sequence: Synthetic Peptide
FKLPMDIL

SEQ ID NO: 80 - protein, 8 aa, Artificial Sequence
  Description of Artificial Sequence: Synthetic Peptide
FKASMRLL

SEQ ID NO: 81 - protein, 8 aa, Artificial Sequence
  Description of Artificial Sequence: Synthetic Peptide
AGNTLSKL

SEQ ID NO: 82 - protein, 8 aa, Artificial Sequence
  Description of Artificial Sequence: Synthetic Peptide
AGSWLDML

SEQ ID NO: 83 - protein, 8 aa, Artificial Sequence
  Description of Artificial Sequence: Synthetic Peptide
AGGYLRGL

SEQ ID NO: 84 - protein, 8 aa, Artificial Sequence
  Description of Artificial Sequence: Synthetic Peptide
AGLVLSFL

SEQ ID NO: 85 - protein, 8 aa, Artificial Sequence
  Description of Artificial Sequence: Synthetic Peptide
AGAALSPL

SEQ ID NO: 86 - protein, 8 aa, Artificial Sequence
  Description of Artificial Sequence: Synthetic Peptide
AGNRMRSL

SEQ ID NO: 87 - protein, 8 aa, Artificial Sequence
  Description of Artificial Sequence: Synthetic Peptide
AGSNMSTL

SEQ ID NO: 88 - protein, 8 aa, Artificial Sequence
  Description of Artificial Sequence: Synthetic Peptide
AGGDMDWL

SEQ ID NO: 89 - protein, 8 aa, Artificial Sequence
  Description of Artificial Sequence: Synthetic Peptide
AGLCMRYL

SEQ ID NO: 90 - protein, 8 aa, Artificial Sequence
  Description of Artificial Sequence: Synthetic Peptide
AGAEMSVL

SEQ ID NO: 91 - protein, 8 aa, Artificial Sequence
  Description of Artificial Sequence: Synthetic Peptide
AKNQLDAL

SEQ ID NO: 92 - protein, 8 aa, Artificial Sequence
  Description of Artificial Sequence: Synthetic Peptide
AKSGLRRL

SEQ ID NO: 93 - protein, 8 aa, Artificial Sequence
  Description of Artificial Sequence: Synthetic Peptide
AKGHLSNL

SEQ ID NO: 94 - protein, 8 aa, Artificial Sequence
  Description of Artificial Sequence: Synthetic Peptide
AKLILDDL

SEQ ID NO: 95 - protein, 8 aa, Artificial Sequence
  Description of Artificial Sequence: Synthetic Peptide
AKALLRCL

SEQ ID NO: 96 - protein, 8 aa, Artificial Sequence
  Description of Artificial Sequence: Synthetic Peptide
AKNKMSEL

SEQ ID NO: 97 - protein, 8 aa, Artificial Sequence
  Description of Artificial Sequence: Synthetic Peptide
AKSMMDQL

SEQ ID NO: 98 - protein, 8 aa, Artificial Sequence
  Description of Artificial Sequence: Synthetic Peptide
AKGGMRGL

SEQ ID NO: 99 - protein, 8 aa, Artificial Sequence
  Description of Artificial Sequence: Synthetic Peptide
AKLFMSHL

SEQ ID NO: 100 - protein, 8 aa, Artificial Sequence
  Description of Artificial Sequence: Synthetic Peptide
AKAPMDIL

SEQ ID NO: 101 - protein, 8 aa, Artificial Sequence
  Description of Artificial Sequence: Synthetic Peptide
LGNSLRLL

SEQ ID NO: 102 - protein, 8 aa, Artificial Sequence
  Description of Artificial Sequence: Synthetic Peptide
LGSTLSKL

SEQ ID NO: 103 - protein, 8 aa, Artificial Sequence
  Description of Artificial Sequence: Synthetic Peptide
LGGWLDML

SEQ ID NO: 104 - protein, 8 aa, Artificial Sequence
  Description of Artificial Sequence: Synthetic Peptide
LGLYLRGL

SEQ ID NO: 105 - protein, 8 aa, Artificial Sequence
  Description of Artificial Sequence: Synthetic Peptide
LGAVLSFL

SEQ ID NO: 106 - protein, 8 aa, Artificial Sequence
  Description of Artificial Sequence: Synthetic Peptide
LGNAMDPL

SEQ ID NO: 107 - protein, 8 aa, Artificial Sequence
  Description of Artificial Sequence: Synthetic Peptide
LGSRMRSL

SEQ ID NO: 108 - protein, 8 aa, Artificial Sequence
  Description of Artificial Sequence: Synthetic Peptide
LGGNMSTL

SEQ ID NO: 109 - protein, 8 aa, Artificial Sequence
  Description of Artificial Sequence: Synthetic Peptide
LGLDMDWL

SEQ ID NO: 110 - protein, 8 aa, Artificial Sequence
  Description of Artificial Sequence: Synthetic Peptide
LGACMRYL

SEQ ID NO: 111 - protein, 8 aa, Artificial Sequence
  Description of Artificial Sequence: Synthetic Peptide
LKNELSVL

SEQ ID NO: 112 - protein, 8 aa, Artificial Sequence
  Description of Artificial Sequence: Synthetic Peptide
LKSQLDAL

SEQ ID NO: 113 - protein, 8 aa, Artificial Sequence
  Description of Artificial Sequence: Synthetic Peptide
LKGGLRRL

SEQ ID NO: 114 - protein, 8 aa, Artificial Sequence
  Description of Artificial Sequence: Synthetic Peptide
LKLHLSNL

SEQ ID NO: 115 - protein, 8 aa, Artificial Sequence
  Description of Artificial Sequence: Synthetic Peptide
LKAILDDL

SEQ ID NO: 116 - protein, 8 aa, Artificial Sequence
  Description of Artificial Sequence: Synthetic Peptide
LKNLMRCL

SEQ ID NO: 117 - protein, 8 aa, Artificial Sequence
  Description of Artificial Sequence: Synthetic Peptide
LKSKMSEL

SEQ ID NO: 118 - protein, 8 aa, Artificial Sequence
  Description of Artificial Sequence: Synthetic Peptide
LKGMMDQL

SEQ ID NO: 119 - protein, 8 aa, Artificial Sequence
  Description of Artificial Sequence: Synthetic Peptide
LKLGMRGL

SEQ ID NO: 120 - protein, 8 aa, Artificial Sequence
  Description of Artificial Sequence: Synthetic Peptide
LKAFMSHL

SEQ ID NO: 121 - protein, 15 aa, Artificial Sequence
  Description of Artificial Sequence: Synthetic Peptide
PNEEAGAALSPLPEV

SEQ ID NO: 122 - protein, 15 aa, Artificial Sequence
  Description of Artificial Sequence: Synthetic Peptide
RSSCAGAALSPLGAC

SEQ ID NO: 123 - protein, 8 aa, Artificial Sequence
  Description of Artificial Sequence: Synthetic Peptide
AGAKLSPL

SEQ ID NO: 124 - protein, 15 aa, Artificial Sequence
  Description of Artificial Sequence: Synthetic Peptide
RSSCFGGRIDRIGAC

SEQ ID NO: 125 - protein, 37 aa, Artificial Sequence
  Description of Artificial Sequence: Synthetic Peptide
EVVPPQVLSEPNEEAGAALSPLPEVPPWTGEVSPAQR

SEQ ID NO: 126 - protein, 28 aa, Artificial Sequence
  Description of Artificial Sequence: Synthetic Peptide
SLRRSSCFGGRMDRIGAQSGLGCNSFRY

SEQ ID NO: 127 - protein, 8 aa, Artificial Sequence
  Description of Artificial Sequence: Synthetic Peptide
FGLKLDRI

SEQ ID NO: 128 - protein, 8 aa, Artificial Sequence
  Description of Artificial Sequence: Synthetic Peptide
FKNLLDHL

SEQ ID NO: 129 - protein, 8 aa, Artificial Sequence
  Description of Artificial Sequence: Synthetic Peptide
LKSKLRAL

SEQ ID NO: 130 - protein, 8 aa, Artificial Sequence
  Description of Artificial Sequence: Synthetic Peptide
FGKRMDRI

SEQ ID NO: 131 - protein, 8 aa, Artificial Sequence
  Description of Artificial Sequence: Synthetic Peptide
  SITE (1)..(1): Xaa is Phe, Ala or Leu
  SITE (2)..(2): Xaa is Gly or Lys
  SITE (3)..(3): Xaa is Asn, Ser, Gyl, Leu or Ala
  SITE (4)..(4): Xaa is any amino acid
  SITE (5)..(5): Xaa is Leu or Met
  SITE (6)..(6): Xaa is Ser, Asp or Arg
  SITE (7)..(7): Xaa is any amino acid
  SITE (8)..(8): Xaa is Ile or Leu
XXXXXXXX

SEQ ID NO: 132 - protein, 15 aa, Artificial Sequence
  Description of Artificial Sequence: Synthetic Peptide
RSSCAGKALSPLGAC

SEQ ID NO: 133 - protein, 8 aa, Artificial Sequence
  Description of Artificial Sequence: Synthetic Peptide
  SITE (7)..(7): Xaa is C, N, P, Q, or R
AGADIDXI

SEQ ID NO: 134 - protein, 8 aa, Artificial Sequence
  Description of Artificial Sequence: Synthetic Peptide
  SITE (7)..(7): Xaa is C, F, G, or H
AGADIDXL

SEQ ID NO: 135 - protein, 8 aa, Artificial Sequence
  Description of Artificial Sequence: Synthetic Peptide
  SITE (7)..(7): Xaa is C, I, K, Q, or W
AGADIRXI

SEQ ID NO: 136 - protein, 8 aa, Artificial Sequence
  Description of Artificial Sequence: Synthetic Peptide
  SITE (7)..(7): Xaa is C, M, N, or P
AGADLRXI

SEQ ID NO: 137 - protein, 8 aa, Artificial Sequence
  Description of Artificial Sequence: Synthetic Peptide
  SITE (7)..(7): Xaa is H, K, or R
AGADIRXL

SEQ ID NO: 138 - protein, 8 aa, Artificial Sequence
  Description of Artificial Sequence: Synthetic Peptide
AGADLRCL

SEQ ID NO: 139 - protein, 8 aa, Artificial Sequence
  Description of Artificial Sequence: Synthetic Peptide
  SITE (7)..(7): Xaa is H, N, or P
AGADISXI

SEQ ID NO: 140 - protein, 8 aa, Artificial Sequence
  Description of Artificial Sequence: Synthetic Peptide
  SITE (7)..(7): Xaa is C, W, or Y
AGADLSXI

SEQ ID NO: 141 - protein, 8 aa, Artificial Sequence
  Description of Artificial Sequence: Synthetic Peptide
  SITE (7)..(7): Xaa is N or W
AGADISXL

SEQ ID NO: 142 - protein, 8 aa, Artificial Sequence
  Description of Artificial Sequence: Synthetic Peptide
  SITE (7)..(7): Xaa is C, H, or K
AGAEIDXI

SEQ ID NO: 143 - protein, 8 aa, Artificial Sequence
  Description of Artificial Sequence: Synthetic Peptide
  SITE (7)..(7): Xaa is M, Q, or Y
AGAELDXI

SEQ ID NO: 144 - protein, 8 aa, Artificial Sequence
  Description of Artificial Sequence: Synthetic Peptide
  SITE (7)..(7): Xaa is H, T, or W
AGAEIDXL

SEQ ID NO: 145 - protein, 8 aa, Artificial Sequence
  Description of Artificial Sequence: Synthetic Peptide
AGAELDML

SEQ ID NO: 146 - protein, 8 aa, Artificial Sequence
  Description of Artificial Sequence: Synthetic Peptide
  SITE (7)..(7): Xaa is A, C, H, M, N, Q, R, or W
AGAEIRXI

SEQ ID NO: 147 - protein, 8 aa, Artificial Sequence
  Description of Artificial Sequence: Synthetic Peptide
  SITE (7)..(7): Xaa is H, M, or Y
AGAELRXI

SEQ ID NO: 148 - protein, 8 aa, Artificial Sequence
  Description of Artificial Sequence: Synthetic Peptide
  SITE (7)..(7): Xaa is C, H, M, N, or Q
AGAEIRXL

SEQ ID NO: 149 - protein, 8 aa, Artificial Sequence
  Description of Artificial Sequence: Synthetic Peptide
AGAELRCL

SEQ ID NO: 150 - protein, 8 aa, Artificial Sequence
  Description of Artificial Sequence: Synthetic Peptide
  SITE (7)..(7): Xaa is C, H, N, P, or Q
AGAEISXI

SEQ ID NO: 151 - protein, 8 aa, Artificial Sequence
  Description of Artificial Sequence: Synthetic Peptide
  SITE (7)..(7): Xaa is H or T
AGAELSXI

SEQ ID NO: 152 - protein, 8 aa, Artificial Sequence
  Description of Artificial Sequence: Synthetic Peptide
  SITE (7)..(7): Xaa is F, K, P, Q, or V
AGAEISXL

SEQ ID NO: 153 - protein, 8 aa, Artificial Sequence
  Description of Artificial Sequence: Synthetic Peptide
  SITE (7)..(7): Xaa is H, M, or W
AGAELSXL

SEQ ID NO: 154 - protein, 8 aa, Artificial Sequence
  Description of Artificial Sequence: Synthetic Peptide
  SITE (7)..(7): Xaa is C, F, G, H, P, Q, V, or Y
AGANIDXI

SEQ ID NO: 155 - protein, 8 aa, Artificial Sequence
  Description of Artificial Sequence: Synthetic Peptide
  SITE (7)..(7): Xaa is H, I, P, or Y
AGANLDXI

SEQ ID NO: 156 - protein, 8 aa, Artificial Sequence
  Description of Artificial Sequence: Synthetic Peptide
  SITE (7)..(7): Xaa is C, H, P, W, or Y
AGANIDXL

SEQ ID NO: 157 - protein, 8 aa, Artificial Sequence
  Description of Artificial Sequence: Synthetic Peptide
  SITE (7)..(7): Xaa is H, T, or Y
AGANLDXL

SEQ ID NO: 158 - protein, 8 aa, Artificial Sequence
  Description of Artificial Sequence: Synthetic Peptide
  SITE (7)..(7): Xaa is A, C, F, K, M, N, P, Q, T, V, or W
AGANIRXI

SEQ ID NO: 159 - protein, 8 aa, Artificial Sequence
  Description of Artificial Sequence: Synthetic Peptide
  SITE (7)..(7): Xaa is C, F, H, I, K, M, P, R, or Y
AGANLRXI

SEQ ID NO: 160 - protein, 8 aa, Artificial Sequence
  Description of Artificial Sequence: Synthetic Peptide
  SITE (7)..(7): Xaa is A, C, D, F, G, H, K, N, P, Q, W, or Y
AGANIRXL

SEQ ID NO: 161 - protein, 8 aa, Artificial Sequence
  Description of Artificial Sequence: Synthetic Peptide
  SITE (7)..(7): Xaa is C, F, I, K, M, N, W, or Y
AGANLRXL

SEQ ID NO: 162 - protein, 8 aa, Artificial Sequence
  Description of Artificial Sequence: Synthetic Peptide
  SITE (7)..(7): Xaa is C, F, H, K, L, M, or W
AGANISXI

SEQ ID NO: 163 - protein, 8 aa, Artificial Sequence
  Description of Artificial Sequence: Synthetic Peptide
  SITE (7)..(7): Xaa is F, H, K, M, Q, W, or Y
AGANLSXI

SEQ ID NO: 164 - protein, 8 aa, Artificial Sequence
  Description of Artificial Sequence: Synthetic Peptide
  SITE (7)..(7): Xaa is I, K, M, N, P, or Q
AGANISXL

SEQ ID NO: 165 - protein, 8 aa, Artificial Sequence
  Description of Artificial Sequence: Synthetic Peptide
  SITE (7)..(7): Xaa is C, H, or Y
AGANLSXL

SEQ ID NO: 166 - protein, 8 aa, Artificial Sequence
  Description of Artificial Sequence: Synthetic Peptide
  SITE (7)..(7): Xaa is C, F, H, L, M, N, P, Q, S, W, or Y
AGAQIDXI

SEQ ID NO: 167 - protein, 8 aa, Artificial Sequence
  Description of Artificial Sequence: Synthetic Peptide
  SITE (7)..(7): Xaa is F, H, M, N, Q, S, V, or Y
AGAQLDXI

SEQ ID NO: 168 - protein, 8 aa, Artificial Sequence
  Description of Artificial Sequence: Synthetic Peptide
  SITE (7)..(7): Xaa is C, D, E, L, P, R, or W
AGAQIDXL

SEQ ID NO: 169 - protein, 8 aa, Artificial Sequence
  Description of Artificial Sequence: Synthetic Peptide
  SITE (7)..(7): Xaa is C, F, M, or W
AGAQLDXL

SEQ ID NO: 170 - protein, 8 aa, Artificial Sequence
  Description of Artificial Sequence: Synthetic Peptide
  SITE (7)..(7): Xaa is C, D, E, F, G, H, I, K ,L, M, N, P, Q, R, or W
AGAQIRXI

SEQ ID NO: 171 - protein, 8 aa, Artificial Sequence
  Description of Artificial Sequence: Synthetic Peptide
  SITE (7)..(7): Xaa is C, D, E, F, G, K, M, W, or Y
AGAQLRXI

SEQ ID NO: 172 - protein, 8 aa, Artificial Sequence
  Description of Artificial Sequence: Synthetic Peptide
  SITE (7)..(7): Xaa is C, K, Q, or W
AGAQIRXL

SEQ ID NO: 173 - protein, 8 aa, Artificial Sequence
  Description of Artificial Sequence: Synthetic Peptide
  SITE (7)..(7): Xaa is C, G, M, or W
AGAQLRXL

SEQ ID NO: 174 - protein, 8 aa, Artificial Sequence
  Description of Artificial Sequence: Synthetic Peptide
  SITE (7)..(7): Xaa is C, E, F, H, M, N, P, R, V ,W, or Y
AGAQISXI

SEQ ID NO: 175 - protein, 8 aa, Artificial Sequence
  Description of Artificial Sequence: Synthetic Peptide
  SITE (7)..(7): Xaa is C, F, I, P, W, or Y
AGAQLSXI

SEQ ID NO: 176 - protein, 8 aa, Artificial Sequence
  Description of Artificial Sequence: Synthetic Peptide
  SITE (7)..(7): Xaa is F, G, K, P, T, or W
AGAQISXL

SEQ ID NO: 177 - protein, 8 aa, Artificial Sequence
  Description of Artificial Sequence: Synthetic Peptide
AGAQLSML

SEQ ID NO: 178 - protein, 8 aa, Artificial Sequence
  Description of Artificial Sequence: Synthetic Peptide
  SITE (7)..(7): Xaa is C, M, P, Q, or T
AGASIDXI

SEQ ID NO: 179 - protein, 8 aa, Artificial Sequence
  Description of Artificial Sequence: Synthetic Peptide
  SITE (7)..(7): Xaa is C, N, Q, or W
AGASIDXL

SEQ ID NO: 180 - protein, 8 aa, Artificial Sequence
  Description of Artificial Sequence: Synthetic Peptide
  SITE (7)..(7): Xaa is C
AGASLDXL

SEQ ID NO: 181 - protein, 8 aa, Artificial Sequence
  Description of Artificial Sequence: Synthetic Peptide
AGASIRCI

SEQ ID NO: 182 - protein, 8 aa, Artificial Sequence
  Description of Artificial Sequence: Synthetic Peptide
  SITE (7)..(7): Xaa is C, H, I, N, Q, or Y
AGASLRXI

SEQ ID NO: 183 - protein, 8 aa, Artificial Sequence
  Description of Artificial Sequence: Synthetic Peptide
  SITE (7)..(7): Xaa is C, V, W, or Y
AGASIRXL

SEQ ID NO: 184 - protein, 8 aa, Artificial Sequence
  Description of Artificial Sequence: Synthetic Peptide
  SITE (7)..(7): Xaa is K
AGASISXI

SEQ ID NO: 185 - protein, 8 aa, Artificial Sequence
  Description of Artificial Sequence: Synthetic Peptide
AGASLSKI

SEQ ID NO: 186 - protein, 8 aa, Artificial Sequence
  Description of Artificial Sequence: Synthetic Peptide
  SITE (7)..(7): Xaa is C, H, K, or Y
AGASISXL

SEQ ID NO: 187 - protein, 8 aa, Artificial Sequence
  Description of Artificial Sequence: Synthetic Peptide
  SITE (7)..(7): Xaa is C, F, G, H, K, M, P, Q, S, or W
AGGDIDXI

SEQ ID NO: 188 - protein, 8 aa, Artificial Sequence
  Description of Artificial Sequence: Synthetic Peptide
  SITE (7)..(7): Xaa is C, D, M, or S
AGGDLDXI

SEQ ID NO: 189 - protein, 8 aa, Artificial Sequence
  Description of Artificial Sequence: Synthetic Peptide
  SITE (7)..(7): Xaa is D, H, S, or W
AGGDIDXL

SEQ ID NO: 190 - protein, 8 aa, Artificial Sequence
  Description of Artificial Sequence: Synthetic Peptide
  SITE (7)..(7): Xaa is C, or W
AGGDLDXL

SEQ ID NO: 191 - protein, 8 aa, Artificial Sequence
  Description of Artificial Sequence: Synthetic Peptide
  SITE (7)..(7): Xaa is C, D, P, or W
AGGDIRXI

SEQ ID NO: 192 - protein, 8 aa, Artificial Sequence
  Description of Artificial Sequence: Synthetic Peptide
AGGDLRPI

SEQ ID NO: 193 - protein, 8 aa, Artificial Sequence
  Description of Artificial Sequence: Synthetic Peptide
  SITE (7)..(7): Xaa is C or F
AGGDLRXL

SEQ ID NO: 194 - protein, 7 aa, Artificial Sequence
  Description of Artificial Sequence: Synthetic Peptide
  SITE (7)..(7): Xaa is I, P, or Y
AGGDISI

SEQ ID NO: 195 - protein, 8 aa, Artificial Sequence
  Description of Artificial Sequence: Synthetic Peptide
  SITE (7)..(7): Xaa is C, F, K, P, or W
AGGDLSXI

SEQ ID NO: 196 - protein, 8 aa, Artificial Sequence
  Description of Artificial Sequence: Synthetic Peptide
  SITE (7)..(7): Xaa is H, S, W, or Y
AGGDISXL

SEQ ID NO: 197 - protein, 8 aa, Artificial Sequence
  Description of Artificial Sequence: Synthetic Peptide
  SITE (7)..(7): Xaa is C, F, or H
AGGDLSXL

SEQ ID NO: 198 - protein, 8 aa, Artificial Sequence
  Description of Artificial Sequence: Synthetic Peptide
  SITE (7)..(7): Xaa is C, E, F, M, N, P, Q, R, S, or Y
AGGEIDXI

SEQ ID NO: 199 - protein, 7 aa, Artificial Sequence
  Description of Artificial Sequence: Synthetic Peptide
  SITE (7)..(7): Xaa is C, D, G, I, M, N, P, Q, S, V, or W
AGGELDI

SEQ ID NO: 200 - protein, 7 aa, Artificial Sequence
  Description of Artificial Sequence: Synthetic Peptide
  SITE (7)..(7): Xaa is C, H, M, N, P, S, W, or Y
AGGEIDL

SEQ ID NO: 201 - protein, 8 aa, Artificial Sequence
  Description of Artificial Sequence: Synthetic Peptide
AGGELDCL

SEQ ID NO: 202 - protein, 8 aa, Artificial Sequence
  Description of Artificial Sequence: Synthetic Peptide
  SITE (7)..(7): Xaa is A, F, G, H, I, K, M, N, R, or W
AGGEIRXI

SEQ ID NO: 203 - protein, 8 aa, Artificial Sequence
  Description of Artificial Sequence: Synthetic Peptide
  SITE (7)..(7): Xaa is C, E, G, K, M, P, Q, or T
AGGELRXI

SEQ ID NO: 204 - protein, 8 aa, Artificial Sequence
  Description of Artificial Sequence: Synthetic Peptide
AGGEIRML

SEQ ID NO: 205 - protein, 8 aa, Artificial Sequence
  Description of Artificial Sequence: Synthetic Peptide
  SITE (7)..(7): Xaa is I, M, N, or Y
AGGELRXL

SEQ ID NO: 206 - protein, 8 aa, Artificial Sequence
  Description of Artificial Sequence: Synthetic Peptide
  SITE (7)..(7): Xaa is A, E, F, H, I, M, N, R, S, W, and Y
AGGEISXI

SEQ ID NO: 207 - protein, 8 aa, Artificial Sequence
  Description of Artificial Sequence: Synthetic Peptide
  SITE (7)..(7): Xaa is C, F, H, K, M, N, P, Q, S, and W
AGGELSXI

SEQ ID NO: 208 - protein, 8 aa, Artificial Sequence
  Description of Artificial Sequence: Synthetic Peptide
  SITE (7)..(7): Xaa is C, H, M, or  W
AGGEISXL

SEQ ID NO: 209 - protein, 8 aa, Artificial Sequence
  Description of Artificial Sequence: Synthetic Peptide
  SITE (7)..(7): Xaa is M, P, or Y
AGGELSXL

SEQ ID NO: 210 - protein, 8 aa, Artificial Sequence
  Description of Artificial Sequence: Synthetic Peptide
  SITE (7)..(7): Xaa is C, D, F, G, H, L, M, P, S, T, W, or Y
AGGNIDXI

SEQ ID NO: 211 - protein, 8 aa, Artificial Sequence
  Description of Artificial Sequence: Synthetic Peptide
  SITE (7)..(7): Xaa is C, D, F, G, N, S, W, or Y
AGGNLDXI

SEQ ID NO: 212 - protein, 8 aa, Artificial Sequence
  Description of Artificial Sequence: Synthetic Peptide
  SITE (7)..(7): Xaa is C, F, G, K, M, P, R, or W
AGGNIDXL

SEQ ID NO: 213 - protein, 8 aa, Artificial Sequence
  Description of Artificial Sequence: Synthetic Peptide
  SITE (7)..(7): Xaa is C, G, H, I, K, M, or Q
AGGNLDXL

SEQ ID NO: 214 - protein, 8 aa, Artificial Sequence
  Description of Artificial Sequence: Synthetic Peptide
  SITE (7)..(7): Xaa is C, F, H, I, L, M, P, R, V, W, or Y
AGGNIRXI

SEQ ID NO: 215 - protein, 8 aa, Artificial Sequence
  Description of Artificial Sequence: Synthetic Peptide
  SITE (7)..(7): Xaa is C, D, H, I, K, L, N, P, R, V, W, or Y
AGGNLRXI

SEQ ID NO: 216 - protein, 8 aa, Artificial Sequence
  Description of Artificial Sequence: Synthetic Peptide
  SITE (7)..(7): Xaa is F, G, I, M, P, Q, W, or Y
AGGNIRXL

SEQ ID NO: 217 - protein, 8 aa, Artificial Sequence
  Description of Artificial Sequence: Synthetic Peptide
  SITE (7)..(7): Xaa is C, D, E, G, M, P, Q, or W
AGGNISXI

SEQ ID NO: 218 - protein, 8 aa, Artificial Sequence
  Description of Artificial Sequence: Synthetic Peptide
  SITE (7)..(7): Xaa is D, F, M, W, or Y
AGGNLSXI

SEQ ID NO: 219 - protein, 8 aa, Artificial Sequence
  Description of Artificial Sequence: Synthetic Peptide
  SITE (7)..(7): Xaa is C, P, or W
AGGNISXL

SEQ ID NO: 220 - protein, 8 aa, Artificial Sequence
  Description of Artificial Sequence: Synthetic Peptide
  SITE (7)..(7): Xaa is C, F, K, or Q
AGGNLSXL

SEQ ID NO: 221 - protein, 8 aa, Artificial Sequence
  Description of Artificial Sequence: Synthetic Peptide
  SITE (7)..(7): Xaa is C, E, F, K, M, N, P, Q, T, V, W, or Y
AGGQIDXI

SEQ ID NO: 222 - protein, 8 aa, Artificial Sequence
  Description of Artificial Sequence: Synthetic Peptide
  SITE (7)..(7): Xaa is C, E, H, I, K, N, P, R, V, or Y
AGGQLDXI

SEQ ID NO: 223 - protein, 8 aa, Artificial Sequence
  Description of Artificial Sequence: Synthetic Peptide
  SITE (7)..(7): Xaa is C, D, F, H, L, M, N, W, or Y
AGGQIDXL

SEQ ID NO: 224 - protein, 8 aa, Artificial Sequence
  Description of Artificial Sequence: Synthetic Peptide
  SITE (7)..(7): Xaa is C, D, F, G, H, M, N, or Q
AGGQLDXL

SEQ ID NO: 225 - protein, 8 aa, Artificial Sequence
  Description of Artificial Sequence: Synthetic Peptide
  SITE (7)..(7): Xaa is C, E, G, H, L, N, P, R, S, T, V, W, or Y
AGGQIRXI

SEQ ID NO: 226 - protein, 8 aa, Artificial Sequence
  Description of Artificial Sequence: Synthetic Peptide
  SITE (7)..(7): Xaa is C, F, H, L, M, N, P, S, or W
AGGQLRXI

SEQ ID NO: 227 - protein, 8 aa, Artificial Sequence
  Description of Artificial Sequence: Synthetic Peptide
  SITE (7)..(7): Xaa is C, E, F, G, H, I, K, M, Q, or S
AGGQIRXL

SEQ ID NO: 228 - protein, 8 aa, Artificial Sequence
  Description of Artificial Sequence: Synthetic Peptide
  SITE (7)..(7): Xaa is C, F, H, N, T, or Y
AGGQLRXL

SEQ ID NO: 229 - protein, 8 aa, Artificial Sequence
  Description of Artificial Sequence: Synthetic Peptide
  SITE (7)..(7): Xaa is A, C, D, E, I, K, L, N, P, Q, R, T, W, or Y
AGGQISXI

SEQ ID NO: 230 - protein, 8 aa, Artificial Sequence
  Description of Artificial Sequence: Synthetic Peptide
  SITE (7)..(7): Xaa is A, C, D, E, H, I, K, M, N, R, T, W, or Y
AGGQLSXI

SEQ ID NO: 231 - protein, 8 aa, Artificial Sequence
  Description of Artificial Sequence: Synthetic Peptide
  SITE (7)..(7): Xaa is H, I, M, N, Q, T, or Y
AGGQISXL

SEQ ID NO: 232 - protein, 8 aa, Artificial Sequence
  Description of Artificial Sequence: Synthetic Peptide
  SITE (7)..(7): Xaa is I, M, P, W, or Y
AGGQLSXL

SEQ ID NO: 233 - protein, 8 aa, Artificial Sequence
  Description of Artificial Sequence: Synthetic Peptide
  SITE (7)..(7): Xaa is C, F, H, I, K, M, P, V, W, or Y
AGGSIDXI

SEQ ID NO: 234 - protein, 8 aa, Artificial Sequence
  Description of Artificial Sequence: Synthetic Peptide
  SITE (7)..(7): Xaa is C, F, or I
AGGSLDXI

SEQ ID NO: 235 - protein, 8 aa, Artificial Sequence
  Description of Artificial Sequence: Synthetic Peptide
  SITE (7)..(7): Xaa is C, M, W, or Y
AGGSIDXL

SEQ ID NO: 236 - protein, 8 aa, Artificial Sequence
  Description of Artificial Sequence: Synthetic Peptide
  SITE (7)..(7): Xaa is H, M, P, R, or W
AGGSIRXI

SEQ ID NO: 237 - protein, 8 aa, Artificial Sequence
  Description of Artificial Sequence: Synthetic Peptide
  SITE (7)..(7): Xaa is E, F, M, or W
AGGSLRXI

SEQ ID NO: 238 - protein, 8 aa, Artificial Sequence
  Description of Artificial Sequence: Synthetic Peptide
  SITE (7)..(7): Xaa is C, E, M, R, W, or Y
AGGSIRXL

SEQ ID NO: 239 - protein, 8 aa, Artificial Sequence
  Description of Artificial Sequence: Synthetic Peptide
AGGSLRYL

SEQ ID NO: 240 - protein, 8 aa, Artificial Sequence
  Description of Artificial Sequence: Synthetic Peptide
  SITE (7)..(7): Xaa is C, F, H, I, K, M, P, V, W, or Y
AGGSISXI

SEQ ID NO: 241 - protein, 8 aa, Artificial Sequence
  Description of Artificial Sequence: Synthetic Peptide
  SITE (7)..(7): Xaa is C, R, V, or W
AGGSLSXI

SEQ ID NO: 242 - protein, 8 aa, Artificial Sequence
  Description of Artificial Sequence: Synthetic Peptide
  SITE (7)..(7): Xaa is C, E, M, R, W, or Y
AGGSISXL

SEQ ID NO: 243 - protein, 8 aa, Artificial Sequence
  Description of Artificial Sequence: Synthetic Peptide
  SITE (7)..(7): Xaa is C, or Y
AGGSLSXL

SEQ ID NO: 244 - protein, 8 aa, Artificial Sequence
  Description of Artificial Sequence: Synthetic Peptide
  SITE (7)..(7): Xaa is C, E, L, N, P, W, or Y
AGLDIDXI

SEQ ID NO: 245 - protein, 8 aa, Artificial Sequence
  Description of Artificial Sequence: Synthetic Peptide
  SITE (7)..(7): Xaa is F, M, W, or Y
AGLDLDXI

SEQ ID NO: 246 - protein, 8 aa, Artificial Sequence
  Description of Artificial Sequence: Synthetic Peptide
  SITE (7)..(7): Xaa is C, F, H, or P
AGLDIDXL

SEQ ID NO: 247 - protein, 8 aa, Artificial Sequence
  Description of Artificial Sequence: Synthetic Peptide
AGLDLDCL

SEQ ID NO: 248 - protein, 8 aa, Artificial Sequence
  Description of Artificial Sequence: Synthetic Peptide
  SITE (7)..(7): Xaa is C, F, K, L, W, or Y
AGLDIRXI

SEQ ID NO: 249 - protein, 8 aa, Artificial Sequence
  Description of Artificial Sequence: Synthetic Peptide
  SITE (7)..(7): Xaa is C, H, M, or W
AGLDLRXI

SEQ ID NO: 250 - protein, 8 aa, Artificial Sequence
  Description of Artificial Sequence: Synthetic Peptide
  SITE (7)..(7): Xaa is H, K, or W
AGLDIRXL

SEQ ID NO: 251 - protein, 8 aa, Artificial Sequence
  Description of Artificial Sequence: Synthetic Peptide
  SITE (7)..(7): Xaa is C, F, H, R or W
AGLDISXI

SEQ ID NO: 252 - protein, 8 aa, Artificial Sequence
  Description of Artificial Sequence: Synthetic Peptide
  SITE (7)..(7): Xaa is C, F, W, or Y
AGLDLSXI

SEQ ID NO: 253 - protein, 8 aa, Artificial Sequence
  Description of Artificial Sequence: Synthetic Peptide
  SITE (7)..(7): Xaa is C, M, or W
AGLDISXL

SEQ ID NO: 254 - protein, 8 aa, Artificial Sequence
  Description of Artificial Sequence: Synthetic Peptide
AGLDLSWL

SEQ ID NO: 255 - protein, 8 aa, Artificial Sequence
  Description of Artificial Sequence: Synthetic Peptide
  SITE (7)..(7): Xaa is C, H, K, Q, or W
AGLEIDXI

SEQ ID NO: 256 - protein, 8 aa, Artificial Sequence
  Description of Artificial Sequence: Synthetic Peptide
  SITE (7)..(7): Xaa is C, F, or H
AGLELDXI

SEQ ID NO: 257 - protein, 8 aa, Artificial Sequence
  Description of Artificial Sequence: Synthetic Peptide
  SITE (7)..(7): Xaa is C, D, M, P, Q, or T
AGLEIDXL

SEQ ID NO: 258 - protein, 8 aa, Artificial Sequence
  Description of Artificial Sequence: Synthetic Peptide
  SITE (7)..(7): Xaa is C, I, M, P, W, or Y
AGLELDXL

SEQ ID NO: 259 - protein, 8 aa, Artificial Sequence
  Description of Artificial Sequence: Synthetic Peptide
  SITE (7)..(7): Xaa is C, H, I, M, P, Q, R, W, or Y
AGLEIRXI

SEQ ID NO: 260 - protein, 8 aa, Artificial Sequence
  Description of Artificial Sequence: Synthetic Peptide
  SITE (7)..(7): Xaa is C, F, H, I, or Y
AGLELRXI

SEQ ID NO: 261 - protein, 8 aa, Artificial Sequence
  Description of Artificial Sequence: Synthetic Peptide
  SITE (7)..(7): Xaa is C, H, or W
AGLEIRXL

SEQ ID NO: 262 - protein, 8 aa, Artificial Sequence
  Description of Artificial Sequence: Synthetic Peptide
  SITE (7)..(7): Xaa is C, W, or Y
AGLELRXL

SEQ ID NO: 263 - protein, 8 aa, Artificial Sequence
  Description of Artificial Sequence: Synthetic Peptide
  SITE (7)..(7): Xaa is C, K, T, or W
AGLEISXI

SEQ ID NO: 264 - protein, 8 aa, Artificial Sequence
  Description of Artificial Sequence: Synthetic Peptide
  SITE (7)..(7): Xaa is M or Y
AGLELSXI

SEQ ID NO: 265 - protein, 8 aa, Artificial Sequence
  Description of Artificial Sequence: Synthetic Peptide
  SITE (7)..(7): Xaa is C, H, M, V, or W
AGLEISXL

SEQ ID NO: 266 - protein, 8 aa, Artificial Sequence
  Description of Artificial Sequence: Synthetic Peptide
  SITE (7)..(7): Xaa is C, F, H, N, R, V, W, or Y
AGLNIDXI

SEQ ID NO: 267 - protein, 8 aa, Artificial Sequence
  Description of Artificial Sequence: Synthetic Peptide
  SITE (7)..(7): Xaa is C, F, G, H, Q, S, V, W, or Y
AGLNLDXI

SEQ ID NO: 268 - protein, 8 aa, Artificial Sequence
  Description of Artificial Sequence: Synthetic Peptide
  SITE (7)..(7): Xaa is A, C, H, P, or W
AGLNIDXL

SEQ ID NO: 269 - protein, 8 aa, Artificial Sequence
  Description of Artificial Sequence: Synthetic Peptide
  SITE (7)..(7): Xaa is C or M
AGLNLDXL

SEQ ID NO: 270 - protein, 8 aa, Artificial Sequence
  Description of Artificial Sequence: Synthetic Peptide
  SITE (7)..(7): Xaa is C, F, G, H, K, L, M, N, P, Q, R, S, T, V, W, or Y
AGLNIRXI

SEQ ID NO: 271 - protein, 8 aa, Artificial Sequence
  Description of Artificial Sequence: Synthetic Peptide
  SITE (7)..(7): Xaa is C, G, H, I, M, N, Q, W, or Y
AGLNLRXI

SEQ ID NO: 272 - protein, 8 aa, Artificial Sequence
  Description of Artificial Sequence: Synthetic Peptide
  SITE (7)..(7): Xaa is C, F, Q, S, W, or Y
AGLNIRXL

SEQ ID NO: 273 - protein, 8 aa, Artificial Sequence
  Description of Artificial Sequence: Synthetic Peptide
  SITE (7)..(7): Xaa is C, F, M, N, or W
AGLNLRXL

SEQ ID NO: 274 - protein, 8 aa, Artificial Sequence
  Description of Artificial Sequence: Synthetic Peptide
  SITE (7)..(7): Xaa is C, I, M, P, W, or Y
AGLNISXI

SEQ ID NO: 275 - protein, 8 aa, Artificial Sequence
  Description of Artificial Sequence: Synthetic Peptide
  SITE (7)..(7): Xaa is C, H, V, or Y
AGLNLSXI

SEQ ID NO: 276 - protein, 8 aa, Artificial Sequence
  Description of Artificial Sequence: Synthetic Peptide
  SITE (7)..(7): Xaa is C, G, H, L, M, or P
AGLNISXL

SEQ ID NO: 277 - protein, 8 aa, Artificial Sequence
  Description of Artificial Sequence: Synthetic Peptide
  SITE (7)..(7): Xaa is C, Q, or W
AGLNLSXL

SEQ ID NO: 278 - protein, 8 aa, Artificial Sequence
  Description of Artificial Sequence: Synthetic Peptide
  SITE (7)..(7): Xaa is C, F, G, H, I, L, N, P, Q, S, T, V, or W
AGLQIDXI

SEQ ID NO: 279 - protein, 8 aa, Artificial Sequence
  Description of Artificial Sequence: Synthetic Peptide
  SITE (7)..(7): Xaa is A, C, E, F, H, K, P, S, T, V, or W
AGLQLDXI

SEQ ID NO: 280 - protein, 8 aa, Artificial Sequence
  Description of Artificial Sequence: Synthetic Peptide
  SITE (7)..(7): Xaa is A, C, E, F, G, I, S, or W
AGLQIDXL

SEQ ID NO: 281 - protein, 8 aa, Artificial Sequence
  Description of Artificial Sequence: Synthetic Peptide
  SITE (7)..(7): Xaa is C, F, H, M, or W
AGLQLDXL

SEQ ID NO: 282 - protein, 8 aa, Artificial Sequence
  Description of Artificial Sequence: Synthetic Peptide
  SITE (7)..(7): Xaa is A, C, F, H, I, K, M, N, P, Q, V, W, or Y
AGLQIRXI

SEQ ID NO: 283 - protein, 7 aa, Artificial Sequence
  Description of Artificial Sequence: Synthetic Peptide
  SITE (7)..(7): Xaa is C, D, G, I, K, L, M, P, Q, R, T, V, W, or Y
AGLQLRI

SEQ ID NO: 284 - protein, 8 aa, Artificial Sequence
  Description of Artificial Sequence: Synthetic Peptide
  SITE (7)..(7): Xaa is C, E, F, H, I, T, W, or Y
AGLQIRXL

SEQ ID NO: 285 - protein, 8 aa, Artificial Sequence
  Description of Artificial Sequence: Synthetic Peptide
  SITE (7)..(7): Xaa is I, K, L, or W
AGLQLRXL

SEQ ID NO: 286 - protein, 8 aa, Artificial Sequence
  Description of Artificial Sequence: Synthetic Peptide
  SITE (7)..(7): Xaa is C, F, G, I, M, S, V, W, or Y
AGLQISXI

SEQ ID NO: 287 - protein, 8 aa, Artificial Sequence
  Description of Artificial Sequence: Synthetic Peptide
  SITE (7)..(7): Xaa is C, H, I, K, P, W, or Y
AGLQLSXI

SEQ ID NO: 288 - protein, 8 aa, Artificial Sequence
  Description of Artificial Sequence: Synthetic Peptide
  SITE (7)..(7): Xaa is C, I, M, Q, or W
AGLQISXL

SEQ ID NO: 289 - protein, 8 aa, Artificial Sequence
  Description of Artificial Sequence: Synthetic Peptide
  SITE (7)..(7): Xaa is C, M, or W
AGLQLSXL

SEQ ID NO: 290 - protein, 8 aa, Artificial Sequence
  Description of Artificial Sequence: Synthetic Peptide
  SITE (7)..(7): Xaa is C, I, L, M, or S
AGLSIDXI

SEQ ID NO: 291 - protein, 8 aa, Artificial Sequence
  Description of Artificial Sequence: Synthetic Peptide
AGLSLDCI

SEQ ID NO: 292 - protein, 8 aa, Artificial Sequence
  Description of Artificial Sequence: Synthetic Peptide
  SITE (7)..(7): Xaa is C, M, or W
AGLSIDXL

SEQ ID NO: 293 - protein, 8 aa, Artificial Sequence
  Description of Artificial Sequence: Synthetic Peptide
  SITE (7)..(7): Xaa is C or F
AGLSLDXL

SEQ ID NO: 294 - protein, 8 aa, Artificial Sequence
  Description of Artificial Sequence: Synthetic Peptide
  SITE (7)..(7): Xaa is I, M, N, or W
AGLSIRXI

SEQ ID NO: 295 - protein, 8 aa, Artificial Sequence
  Description of Artificial Sequence: Synthetic Peptide
  SITE (7)..(7): Xaa is C, F, or H
AGLSLRXI

SEQ ID NO: 296 - protein, 8 aa, Artificial Sequence
  Description of Artificial Sequence: Synthetic Peptide
  SITE (7)..(7): Xaa is I, K, or M
AGLSIRXL

SEQ ID NO: 297 - protein, 8 aa, Artificial Sequence
  Description of Artificial Sequence: Synthetic Peptide
  SITE (7)..(7): Xaa is H or M
AGLSLSXI

SEQ ID NO: 298 - protein, 8 aa, Artificial Sequence
  Description of Artificial Sequence: Synthetic Peptide
  SITE (7)..(7): Xaa is C or H
AGLSISXL

SEQ ID NO: 299 - protein, 8 aa, Artificial Sequence
  Description of Artificial Sequence: Synthetic Peptide
  SITE (7)..(7): Xaa is C, D, F, G, L, M, N, P, Q, R, S, T, V, or W
AGNDIDXI

SEQ ID NO: 300 - protein, 8 aa, Artificial Sequence
  Description of Artificial Sequence: Synthetic Peptide
  SITE (7)..(7): Xaa is A, D, F, G, H, K, L, S, T, or Y
AGNDLDXI

SEQ ID NO: 301 - protein, 8 aa, Artificial Sequence
  Description of Artificial Sequence: Synthetic Peptide
  SITE (7)..(7): Xaa is C, E, H, I, K, M, Q, R, W, or Y
AGNDIDXL

SEQ ID NO: 302 - protein, 8 aa, Artificial Sequence
  Description of Artificial Sequence: Synthetic Peptide
  SITE (7)..(7): Xaa is H, K, or W
AGNDLDXL

SEQ ID NO: 303 - protein, 7 aa, Artificial Sequence
  Description of Artificial Sequence: Synthetic Peptide
  SITE (7)..(7): Xaa is C, I, K, M, N, Q, S, T, V, or W
AGNDIRI

SEQ ID NO: 304 - protein, 7 aa, Artificial Sequence
  Description of Artificial Sequence: Synthetic Peptide
  SITE (7)..(7): Xaa is A, C, D, E, F, G, I, M, ,N Q, S, V, W, or Y
AGNDLRI

SEQ ID NO: 305 - protein, 8 aa, Artificial Sequence
  Description of Artificial Sequence: Synthetic Peptide
  SITE (7)..(7): Xaa is F, M, N, Q, R, T, or W
AGNDIRXL

SEQ ID NO: 306 - protein, 8 aa, Artificial Sequence
  Description of Artificial Sequence: Synthetic Peptide
  SITE (7)..(7): Xaa is C, I, M, W, or Y
AGNDLRXL

SEQ ID NO: 307 - protein, 8 aa, Artificial Sequence
  Description of Artificial Sequence: Synthetic Peptide
  SITE (7)..(7): Xaa is D, E, F, H, or Y
AGNDISXI

SEQ ID NO: 308 - protein, 8 aa, Artificial Sequence
  Description of Artificial Sequence: Synthetic Peptide
  SITE (7)..(7): Xaa is C, D, E, G, H, K, N, P, Q, R, T, or W
AGNDLSXI

SEQ ID NO: 309 - protein, 8 aa, Artificial Sequence
  Description of Artificial Sequence: Synthetic Peptide
  SITE (7)..(7): Xaa is C, G, N ,Q, or T
AGNDISXL

SEQ ID NO: 310 - protein, 8 aa, Artificial Sequence
  Description of Artificial Sequence: Synthetic Peptide
  SITE (7)..(7): Xaa is C, E, H, I, W, or Y
AGNDLSXL

SEQ ID NO: 311 - protein, 8 aa, Artificial Sequence
  Description of Artificial Sequence: Synthetic Peptide
  SITE (7)..(7): Xaa is C, D, F, G, H, K, M, N, P, Q, S, V, W, or Y
AGNEIDXI

SEQ ID NO: 312 - protein, 7 aa, Artificial Sequence
  Description of Artificial Sequence: Synthetic Peptide
  SITE (7)..(7): Xaa is A, C ,H, M, O, Q, T, W, or Y
AGNELDI

SEQ ID NO: 313 - protein, 8 aa, Artificial Sequence
  Description of Artificial Sequence: Synthetic Peptide
  SITE (7)..(7): Xaa is C, F, G, K, P, or Q
AGNEIDXL

SEQ ID NO: 314 - protein, 8 aa, Artificial Sequence
  Description of Artificial Sequence: Synthetic Peptide
  SITE (7)..(7): Xaa is C, F, G ,H, I, K, M, N, Q, S, V, or Y
AGNELDXL

SEQ ID NO: 315 - protein, 8 aa, Artificial Sequence
  Description of Artificial Sequence: Synthetic Peptide
  SITE (7)..(7): Xaa is A, C ,H, M, O, Q, T, W, or Y
AGNELDXL

SEQ ID NO: 316 - protein, 8 aa, Artificial Sequence
  Description of Artificial Sequence: Synthetic Peptide
  SITE (7)..(7): Xaa is A, C, E, F, G, H, K, M, N, P, Q, S, W, or Y
AGNELRXI

SEQ ID NO: 317 - protein, 8 aa, Artificial Sequence
  Description of Artificial Sequence: Synthetic Peptide
  SITE (7)..(7): Xaa is C, D, F, G, H, K, M, N, or W
AGNEIRXL

SEQ ID NO: 318 - protein, 8 aa, Artificial Sequence
  Description of Artificial Sequence: Synthetic Peptide
  SITE (7)..(7): Xaa is C, F, G, H, M, P, V, W, or Y
AGNELRXL

SEQ ID NO: 319 - protein, 8 aa, Artificial Sequence
  Description of Artificial Sequence: Synthetic Peptide
  SITE (7)..(7): Xaa is C, D, E, F, G, H, K, L, M, N, Q, R, S, T, W, or Y
AGNEISXI

SEQ ID NO: 320 - protein, 8 aa, Artificial Sequence
  Description of Artificial Sequence: Synthetic Peptide
  SITE (7)..(7): Xaa is D, H, K, L, M, T, V, or W
AGNELSXI

SEQ ID NO: 321 - protein, 8 aa, Artificial Sequence
  Description of Artificial Sequence: Synthetic Peptide
  SITE (7)..(7): Xaa is A, C, D, G, H, K, L, M, Q, or Y
AGNEISXL

SEQ ID NO: 322 - protein, 8 aa, Artificial Sequence
  Description of Artificial Sequence: Synthetic Peptide
  SITE (7)..(7): Xaa is C, D, W, or Y
AGNELSXL

SEQ ID NO: 323 - protein, 8 aa, Artificial Sequence
  Description of Artificial Sequence: Synthetic Peptide
  SITE (7)..(7): Xaa is A, C, E, F, H, K, L, M, N, P, Q, R, V, W, or Y
AGNNIDXI

SEQ ID NO: 324 - protein, 8 aa, Artificial Sequence
  Description of Artificial Sequence: Synthetic Peptide
  SITE (7)..(7): Xaa is C, E, F, H, K, L, M, N, P, Q, R, T, V, or W
AGNNLDXI

SEQ ID NO: 325 - protein, 8 aa, Artificial Sequence
  Description of Artificial Sequence: Synthetic Peptide
  SITE (7)..(7): Xaa is A, C, F, P, R, W, or Y
AGNNIDXL

SEQ ID NO: 326 - protein, 8 aa, Artificial Sequence
  Description of Artificial Sequence: Synthetic Peptide
  SITE (7)..(7): Xaa is A, C, F, M, R, T, V, or W
AGNNLDXL

SEQ ID NO: 327 - protein, 8 aa, Artificial Sequence
  Description of Artificial Sequence: Synthetic Peptide
  SITE (7)..(7): Xaa is C, F, G, H, L, M, P, R, V, or W
AGNNIRXI

SEQ ID NO: 328 - protein, 8 aa, Artificial Sequence
  Description of Artificial Sequence: Synthetic Peptide
  SITE (7)..(7): Xaa is A, C, D, F, G, I, K, L, N, P, R, T, V, W, or Y
AGNNLRXI

SEQ ID NO: 329 - protein, 8 aa, Artificial Sequence
  Description of Artificial Sequence: Synthetic Peptide
  SITE (7)..(7): Xaa is A, C, E, G, H, I, K, M, N, P, Q, T, V, W, or Y
AGNNIRXL

SEQ ID NO: 330 - protein, 8 aa, Artificial Sequence
  Description of Artificial Sequence: Synthetic Peptide
  SITE (7)..(7): A, C, F, H, I, K, L, M, N, P, Q, T, W, or Y
AGNNLRXL

SEQ ID NO: 331 - protein, 8 aa, Artificial Sequence
  Description of Artificial Sequence: Synthetic Peptide
  SITE (7)..(7): Xaa is C, D, F, G, M, P, R, S, W, or Y
AGNNISXI

SEQ ID NO: 332 - protein, 8 aa, Artificial Sequence
  Description of Artificial Sequence: Synthetic Peptide
  SITE (7)..(7): Xaa is A, C, D, F, G, H, K, M, N, R, S, T, W, or Y
AGNNLSXI

SEQ ID NO: 333 - protein, 8 aa, Artificial Sequence
  Description of Artificial Sequence: Synthetic Peptide
  SITE (7)..(7): Xaa is A, C, G, H, M, N, P, R, or T
AGNNISXL

SEQ ID NO: 334 - protein, 8 aa, Artificial Sequence
  Description of Artificial Sequence: Synthetic Peptide
  SITE (7)..(7): Xaa is A, C, G, H, R, or W
AGNNLSXL

SEQ ID NO: 335 - protein, 8 aa, Artificial Sequence
  Description of Artificial Sequence: Synthetic Peptide
  SITE (7)..(7): Xaa is A, C, D, F, G, H, I, K, M, N, P, Q, R, S, T, W, or Y
AGNQIDXI

SEQ ID NO: 336 - protein, 8 aa, Artificial Sequence
  Description of Artificial Sequence: Synthetic Peptide
  SITE (7)..(7): Xaa is C, D, F, G, H, K, L, M, P, R, T, W, or Y
AGNQLDXI

SEQ ID NO: 337 - protein, 8 aa, Artificial Sequence
  Description of Artificial Sequence: Synthetic Peptide
  SITE (7)..(7): Xaa is A, C, D, E, F, G, P, S, W, or Y
AGNQIDXL

SEQ ID NO: 338 - protein, 8 aa, Artificial Sequence
  Description of Artificial Sequence: Synthetic Peptide
  SITE (7)..(7): Xaa is C, D, E, F, H, M, P, Q, or V
AGNQLDXL

SEQ ID NO: 339 - protein, 8 aa, Artificial Sequence
  Description of Artificial Sequence: Synthetic Peptide
  SITE (7)..(7): Xaa is A, C, E, F, G, I, L, N, P, S, V, or W
AGNQIRXI

SEQ ID NO: 340 - protein, 8 aa, Artificial Sequence
  Description of Artificial Sequence: Synthetic Peptide
  SITE (7)..(7): Xaa is A, C, D, E, H, I, K, L, M, P, V, or W
AGNQLRXI

SEQ ID NO: 341 - protein, 8 aa, Artificial Sequence
  Description of Artificial Sequence: Synthetic Peptide
  SITE (7)..(7): Xaa is C, E, F, G, H, I, L, M, Q, S, T, W, or Y
AGNQIRXL

SEQ ID NO: 342 - protein, 8 aa, Artificial Sequence
  Description of Artificial Sequence: Synthetic Peptide
  SITE (7)..(7): Xaa is C, D, G, I, K, M, P, R, W, or Y
AGNQLRXL

SEQ ID NO: 343 - protein, 8 aa, Artificial Sequence
  Description of Artificial Sequence: Synthetic Peptide
  SITE (7)..(7): Xaa is A, D, F, H, I, K, L, M, Q, T, or W
AGNQISXI

SEQ ID NO: 344 - protein, 8 aa, Artificial Sequence
  Description of Artificial Sequence: Synthetic Peptide
  SITE (7)..(7): Xaa is D, F, I, K, L, M, N, Q, R, or W
AGNQLSXI

SEQ ID NO: 345 - protein, 8 aa, Artificial Sequence
  Description of Artificial Sequence: Synthetic Peptide
  SITE (7)..(7): Xaa is C, D, H, P, Q, W, or Y
AGNQISXL

SEQ ID NO: 346 - protein, 8 aa, Artificial Sequence
  Description of Artificial Sequence: Synthetic Peptide
  SITE (7)..(7): Xaa is C, F, I, M, or N
AGNQLSXL

SEQ ID NO: 347 - protein, 8 aa, Artificial Sequence
  Description of Artificial Sequence: Synthetic Peptide
  SITE (7)..(7): Xaa is C, D, F ,H, I, K, M, N, O, Q, V, W, or Y
AGNSIDXI

SEQ ID NO: 348 - protein, 8 aa, Artificial Sequence
  Description of Artificial Sequence: Synthetic Peptide
  SITE (7)..(7): Xaa is F, H, K, R, T, V, W, or Y
AGNSLDXI

SEQ ID NO: 349 - protein, 8 aa, Artificial Sequence
  Description of Artificial Sequence: Synthetic Peptide
  SITE (7)..(7): Xaa is E, G, H, I, K, R, S, or W
AGNSIDXL

SEQ ID NO: 350 - protein, 8 aa, Artificial Sequence
  Description of Artificial Sequence: Synthetic Peptide
  SITE (7)..(7): Xaa is C, H, or N
AGNSLDXL

SEQ ID NO: 351 - protein, 8 aa, Artificial Sequence
  Description of Artificial Sequence: Synthetic Peptide
  SITE (7)..(7): Xaa is A, C, F, G, H, I, K, M, N, P, Q, R, T, V, W, or Y
AGNSIRXI

SEQ ID NO: 352 - protein, 8 aa, Artificial Sequence
  Description of Artificial Sequence: Synthetic Peptide
  SITE (7)..(7): Xaa is A, C, E, K, M, P, S, W, or Y
AGNSLRXI

SEQ ID NO: 353 - protein, 8 aa, Artificial Sequence
  Description of Artificial Sequence: Synthetic Peptide
  SITE (7)..(7): Xaa is A, E, G, H, I, K, L, N, T, V, or W
AGNSIRXL

SEQ ID NO: 354 - protein, 8 aa, Artificial Sequence
  Description of Artificial Sequence: Synthetic Peptide
  SITE (7)..(7): Xaa is C, D, F, K, M, W, or Y
AGNSLRXL

SEQ ID NO: 355 - protein, 8 aa, Artificial Sequence
  Description of Artificial Sequence: Synthetic Peptide
  SITE (7)..(7): Xaa is C, D, E, F, G, L, M, N, P, R, W, or Y
AGNSISXI

SEQ ID NO: 356 - protein, 8 aa, Artificial Sequence
  Description of Artificial Sequence: Synthetic Peptide
  SITE (7)..(7): Xaa is C, H, L, P, Q, V, or W
AGNSLSXI

SEQ ID NO: 357 - protein, 8 aa, Artificial Sequence
  Description of Artificial Sequence: Synthetic Peptide
  SITE (7)..(7): Xaa is C, H, K, V, or W
AGNSISXL

SEQ ID NO: 358 - protein, 8 aa, Artificial Sequence
  Description of Artificial Sequence: Synthetic Peptide
  SITE (7)..(7): Xaa is C, D, E, F, G, H, I, K, M, P, R, T, or V
AGNSLSXL

SEQ ID NO: 359 - protein, 8 aa, Artificial Sequence
  Description of Artificial Sequence: Synthetic Peptide
  SITE (7)..(7): Xaa is D, E, F, H, K, N, P, R, T, or W
AGSDIDXI

SEQ ID NO: 360 - protein, 8 aa, Artificial Sequence
  Description of Artificial Sequence: Synthetic Peptide
  SITE (7)..(7): Xaa is C, E, F, K, N, S, or W
AGSDLDXI

SEQ ID NO: 361 - protein, 8 aa, Artificial Sequence
  Description of Artificial Sequence: Synthetic Peptide
  SITE (7)..(7): Xaa is K, M, or W
AGSDIDXL

SEQ ID NO: 362 - protein, 8 aa, Artificial Sequence
  Description of Artificial Sequence: Synthetic Peptide
  SITE (7)..(7): Xaa is C, H, or Y
AGSDLDXL

SEQ ID NO: 363 - protein, 8 aa, Artificial Sequence
  Description of Artificial Sequence: Synthetic Peptide
  SITE (7)..(7): Xaa is D, P, Q, R, S, W, or Y
AGSDIRXI

SEQ ID NO: 364 - protein, 8 aa, Artificial Sequence
  Description of Artificial Sequence: Synthetic Peptide
  SITE (7)..(7): Xaa is C, D, E, F, I, K, M, R, T, V, W, or Y
AGSDLRXI

SEQ ID NO: 365 - protein, 8 aa, Artificial Sequence
  Description of Artificial Sequence: Synthetic Peptide
  SITE (7)..(7): Xaa is C, L, M, N, Q, R, or W
AGSDIRXL

SEQ ID NO: 366 - protein, 8 aa, Artificial Sequence
  Description of Artificial Sequence: Synthetic Peptide
  SITE (7)..(7): Xaa is C, N, or Y
AGSDLRXL

SEQ ID NO: 367 - protein, 8 aa, Artificial Sequence
  Description of Artificial Sequence: Synthetic Peptide
  SITE (7)..(7): Xaa is C, E, I, L, P, Q, R, S, or W
AGSDISXI

SEQ ID NO: 368 - protein, 8 aa, Artificial Sequence
  Description of Artificial Sequence: Synthetic Peptide
  SITE (7)..(7): Xaa is C, F, M, P, W, or Y
AGSDLSXI

SEQ ID NO: 369 - protein, 8 aa, Artificial Sequence
  Description of Artificial Sequence: Synthetic Peptide
  SITE (7)..(7): Xaa is A, C, E, M, or W
AGSDISXL

SEQ ID NO: 370 - protein, 8 aa, Artificial Sequence
  Description of Artificial Sequence: Synthetic Peptide
  SITE (7)..(7): Xaa is C, D, G, H, K, N, P, Q, S, V, or W
AGSEIDXI

SEQ ID NO: 371 - protein, 8 aa, Artificial Sequence
  Description of Artificial Sequence: Synthetic Peptide
  SITE (7)..(7): Xaa is C, D, F, L, M, W, or Y
AGSELDXI

SEQ ID NO: 372 - protein, 8 aa, Artificial Sequence
  Description of Artificial Sequence: Synthetic Peptide
  SITE (7)..(7): Xaa is C, E, G, H, M, N, or W
AGSEIDXL

SEQ ID NO: 373 - protein, 8 aa, Artificial Sequence
  Description of Artificial Sequence: Synthetic Peptide
  SITE (7)..(7): Xaa is H, M, or Y
AGSELDXL

SEQ ID NO: 374 - protein, 8 aa, Artificial Sequence
  Description of Artificial Sequence: Synthetic Peptide
  SITE (7)..(7): Xaa is H, I, L, M, P, Q, W, or Y
AGSEIRXI

SEQ ID NO: 375 - protein, 8 aa, Artificial Sequence
  Description of Artificial Sequence: Synthetic Peptide
  SITE (7)..(7): Xaa is C, D, F, M, N, S, or V
AGSELRXI

SEQ ID NO: 376 - protein, 8 aa, Artificial Sequence
  Description of Artificial Sequence: Synthetic Peptide
  SITE (7)..(7): Xaa is C, E, F, H, I, or W
AGSEIRXL

SEQ ID NO: 377 - protein, 8 aa, Artificial Sequence
  Description of Artificial Sequence: Synthetic Peptide
  SITE (7)..(7): Xaa is C, or M
AGSELRXL

SEQ ID NO: 378 - protein, 8 aa, Artificial Sequence
  Description of Artificial Sequence: Synthetic Peptide
  SITE (7)..(7): Xaa is A, C, D, F, I, K, M, Q, R, T, W, or Y
AGSEISXI

SEQ ID NO: 379 - protein, 8 aa, Artificial Sequence
  Description of Artificial Sequence: Synthetic Peptide
  SITE (7)..(7): Xaa is A, C, F, G, K, M, N, P, Q, T, or W
AGSELSXI

SEQ ID NO: 380 - protein, 8 aa, Artificial Sequence
  Description of Artificial Sequence: Synthetic Peptide
  SITE (7)..(7): Xaa is C, F, H, M, or W
AGSEISXL

SEQ ID NO: 381 - protein, 8 aa, Artificial Sequence
  Description of Artificial Sequence: Synthetic Peptide
  SITE (7)..(7): Xaa is C, or Q
AGSELSXL

SEQ ID NO: 382 - protein, 8 aa, Artificial Sequence
  Description of Artificial Sequence: Synthetic Peptide
  SITE (7)..(7): Xaa is A, C, F, G, H, K, N, P, Q, S, T, V, or W
AGSNIDXI

SEQ ID NO: 383 - protein, 8 aa, Artificial Sequence
  Description of Artificial Sequence: Synthetic Peptide
  SITE (7)..(7): Xaa is F, G, I, K, N, R, T, or W
AGSNLDXI

SEQ ID NO: 384 - protein, 8 aa, Artificial Sequence
  Description of Artificial Sequence: Synthetic Peptide
  SITE (7)..(7): Xaa is C, F, H, I, N, P, R, V, or W
AGSNIDXL

SEQ ID NO: 385 - protein, 8 aa, Artificial Sequence
  Description of Artificial Sequence: Synthetic Peptide
  SITE (7)..(7): Xaa is C, F, I, M, N, W, or Y
AGSNLDXL

SEQ ID NO: 386 - protein, 8 aa, Artificial Sequence
  Description of Artificial Sequence: Synthetic Peptide
  SITE (7)..(7): Xaa is A, C, D, F, G, H, I, M, N, P, Q, S, T, or W
AGSNIRXI

SEQ ID NO: 387 - protein, 8 aa, Artificial Sequence
  Description of Artificial Sequence: Synthetic Peptide
  SITE (7)..(7): Xaa is C, D, E, F, H, I, L, M, P, T, W, or Y
AGSNLRXI

SEQ ID NO: 388 - protein, 8 aa, Artificial Sequence
  Description of Artificial Sequence: Synthetic Peptide
  SITE (7)..(7): Xaa is A, C, D, F, G, H, I, M, N, P, Q, S, T, OR W
AGSNIRXI

SEQ ID NO: 389 - protein, 8 aa, Artificial Sequence
  Description of Artificial Sequence: Synthetic Peptide
  SITE (7)..(7): Xaa is C, D, E, F, H, I, L, M, P, T, W, or Y
AGSNLRXI

SEQ ID NO: 390 - protein, 8 aa, Artificial Sequence
  Description of Artificial Sequence: Synthetic Peptide
  SITE (7)..(7): Xaa is A, C, G, H, N, R, S, T, or W
AGSNIRXL

SEQ ID NO: 391 - protein, 8 aa, Artificial Sequence
  Description of Artificial Sequence: Synthetic Peptide
  SITE (7)..(7): Xaa is C, D, H, M, P, V, or W
AGSNLRXL

SEQ ID NO: 392 - protein, 8 aa, Artificial Sequence
  Description of Artificial Sequence: Synthetic Peptide
  SITE (7)..(7): Xaa is A, C, G, H, N, R, S, T, or W
AGSNIRXL

SEQ ID NO: 393 - protein, 8 aa, Artificial Sequence
  Description of Artificial Sequence: Synthetic Peptide
  SITE (7)..(7): Xaa is C, D, H, M, P, V, or W
AGSNLRXL

SEQ ID NO: 394 - protein, 8 aa, Artificial Sequence
  Description of Artificial Sequence: Synthetic Peptide
  SITE (7)..(7): Xaa is A, C, E, H, M, N, Q, S, T, V, or W
AGSNISXI

SEQ ID NO: 395 - protein, 8 aa, Artificial Sequence
  Description of Artificial Sequence: Synthetic Peptide
  SITE (7)..(7): Xaa is C, L, M, V, or Y
AGSNLSXI

SEQ ID NO: 396 - protein, 8 aa, Artificial Sequence
  Description of Artificial Sequence: Synthetic Peptide
  SITE (7)..(7): Xaa is C, H, M, W, or Y
AGSNISXL

SEQ ID NO: 397 - protein, 8 aa, Artificial Sequence
  Description of Artificial Sequence: Synthetic Peptide
  SITE (7)..(7): Xaa is C, M, Q, or W
AGSNLSXL

SEQ ID NO: 398 - protein, 8 aa, Artificial Sequence
  Description of Artificial Sequence: Synthetic Peptide
  SITE (7)..(7): Xaa is C, D, G, H, I, K, L, M, N, P, Q, R, W, or Y
AGSQIDXI

SEQ ID NO: 399 - protein, 8 aa, Artificial Sequence
  Description of Artificial Sequence: Synthetic Peptide
  SITE (7)..(7): Xaa is D, F, G, I, K, M, N, P, R, S, T, V, W, or Y
AGSQLDXI

SEQ ID NO: 400 - protein, 8 aa, Artificial Sequence
  Description of Artificial Sequence: Synthetic Peptide
  SITE (7)..(7): Xaa is C, D, F, G, K, P, Q, S, or W
AGSQIDXL

SEQ ID NO: 401 - protein, 8 aa, Artificial Sequence
  Description of Artificial Sequence: Synthetic Peptide
  SITE (7)..(7): Xaa is F, G, H, M, or T
AGSQLDXL

SEQ ID NO: 402 - protein, 8 aa, Artificial Sequence
  Description of Artificial Sequence: Synthetic Peptide
  SITE (7)..(7): Xaa is C, D, G, H, K, L, M, Q, R, S, T, V, W, or Y
AGSQIRXI

SEQ ID NO: 403 - protein, 8 aa, Artificial Sequence
  Description of Artificial Sequence: Synthetic Peptide
  SITE (7)..(7): Xaa is A, C, D, F, M, P, Q, V, or W
AGSQLRXI

SEQ ID NO: 404 - protein, 8 aa, Artificial Sequence
  Description of Artificial Sequence: Synthetic Peptide
  SITE (7)..(7): Xaa is D, F, I, M, N, P, Q, T, V, W, or Y
AGSQIRXL

SEQ ID NO: 405 - protein, 8 aa, Artificial Sequence
  Description of Artificial Sequence: Synthetic Peptide
  SITE (7)..(7): Xaa is C, E, H, I, M, W, or Y
AGSQLRXL

SEQ ID NO: 406 - protein, 8 aa, Artificial Sequence
  Description of Artificial Sequence: Synthetic Peptide
  SITE (7)..(7): Xaa is C, E, F, H, M, N, Q, S, V, W, or Y
AGSQISXI

SEQ ID NO: 407 - protein, 8 aa, Artificial Sequence
  Description of Artificial Sequence: Synthetic Peptide
  SITE (7)..(7): Xaa is A, F, G, H, I, K, N, P, R, W, or Y
AGSQLSXI

SEQ ID NO: 408 - protein, 8 aa, Artificial Sequence
  Description of Artificial Sequence: Synthetic Peptide
  SITE (7)..(7): Xaa is C, D, G, H, I, K, M, N, T, V, or Y
AGSQISXL

SEQ ID NO: 409 - protein, 8 aa, Artificial Sequence
  Description of Artificial Sequence: Synthetic Peptide
  SITE (7)..(7): Xaa is C, F, H, I, M, N, R, or W
AGSQLSXL

SEQ ID NO: 410 - protein, 8 aa, Artificial Sequence
  Description of Artificial Sequence: Synthetic Peptide
  SITE (7)..(7): Xaa is C, D, E, H, I, K, N, P, R, or W
AGSSIDXI

SEQ ID NO: 411 - protein, 8 aa, Artificial Sequence
  Description of Artificial Sequence: Synthetic Peptide
  SITE (7)..(7): Xaa is C, D, F, I, L, M, S, W, or Y
AGSSLDXI

SEQ ID NO: 412 - protein, 8 aa, Artificial Sequence
  Description of Artificial Sequence: Synthetic Peptide
  SITE (7)..(7): Xaa is C, F, H, K, L, T, or Y
AGSSIDXL

SEQ ID NO: 413 - protein, 8 aa, Artificial Sequence
  Description of Artificial Sequence: Synthetic Peptide
  SITE (7)..(7): Xaa is H, N, or Y
AGSSLDXL

SEQ ID NO: 414 - protein, 8 aa, Artificial Sequence
  Description of Artificial Sequence: Synthetic Peptide
  SITE (7)..(7): Xaa is C, E, G, K, L, M, N, P, Q, R, T, W, or Y
AGSSIRXI

SEQ ID NO: 415 - protein, 8 aa, Artificial Sequence
  Description of Artificial Sequence: Synthetic Peptide
  SITE (7)..(7): Xaa is C, F, H, I, M, or W
AGSSLRXI

SEQ ID NO: 416 - protein, 8 aa, Artificial Sequence
  Description of Artificial Sequence: Synthetic Peptide
  SITE (7)..(7): Xaa is A, C, D, H, M, or T
AGSSIRXL

SEQ ID NO: 417 - protein, 8 aa, Artificial Sequence
  Description of Artificial Sequence: Synthetic Peptide
  SITE (7)..(7): Xaa is C, M, or Y
AGSSLRXL

SEQ ID NO: 418 - protein, 8 aa, Artificial Sequence
  Description of Artificial Sequence: Synthetic Peptide
  SITE (7)..(7): Xaa is C, H, W, or Y
AGSSISXI

SEQ ID NO: 419 - protein, 8 aa, Artificial Sequence
  Description of Artificial Sequence: Synthetic Peptide
  SITE (7)..(7): Xaa is C, Q, or Y
AGSSLSXI

SEQ ID NO: 420 - protein, 8 aa, Artificial Sequence
  Description of Artificial Sequence: Synthetic Peptide
  SITE (7)..(7): Xaa is C, K, or Y
AGSSISXL

SEQ ID NO: 421 - protein, 8 aa, Artificial Sequence
  Description of Artificial Sequence: Synthetic Peptide
AGSSLSCL

SEQ ID NO: 422 - protein, 8 aa, Artificial Sequence
  Description of Artificial Sequence: Synthetic Peptide
  SITE (7)..(7): Xaa is C, F, I, P, T, V, W, or Y
AKADIDXI

SEQ ID NO: 423 - protein, 8 aa, Artificial Sequence
  Description of Artificial Sequence: Synthetic Peptide
  SITE (7)..(7): Xaa is E, F, H, P, W, or Y
AKADLDXI

SEQ ID NO: 424 - protein, 8 aa, Artificial Sequence
  Description of Artificial Sequence: Synthetic Peptide
  SITE (7)..(7): Xaa is C, F, H, I, M, N, or P
AKADIDXL

SEQ ID NO: 425 - protein, 8 aa, Artificial Sequence
  Description of Artificial Sequence: Synthetic Peptide
  SITE (7)..(7): Xaa is C, H, or I
AKADLDXL

SEQ ID NO: 426 - protein, 8 aa, Artificial Sequence
  Description of Artificial Sequence: Synthetic Peptide
  SITE (7)..(7): Xaa is C, D, E, F, G, I, L, M, P, T, V, W, or Y
AKADIRXI

SEQ ID NO: 427 - protein, 8 aa, Artificial Sequence
  Description of Artificial Sequence: Synthetic Peptide
  SITE (7)..(7): Xaa is F, H, I, M, N, Q, V, W, or Y
AKADLRXI

SEQ ID NO: 428 - protein, 8 aa, Artificial Sequence
  Description of Artificial Sequence: Synthetic Peptide
  SITE (7)..(7): Xaa is C, F, G, H, I, N, P, S, or T
AKADIRXL

SEQ ID NO: 429 - protein, 8 aa, Artificial Sequence
  Description of Artificial Sequence: Synthetic Peptide
  SITE (7)..(7): Xaa is C, H, L, M, or W
AKADLRXL

SEQ ID NO: 430 - protein, 8 aa, Artificial Sequence
  Description of Artificial Sequence: Synthetic Peptide
  SITE (7)..(7): Xaa is C, E, H, I, M, P, Q, or W
AKADISXI

SEQ ID NO: 431 - protein, 8 aa, Artificial Sequence
  Description of Artificial Sequence: Synthetic Peptide
  SITE (7)..(7): Xaa is C, E, F, H, I, M, P, Q, V, W, or Y
AKADLSXI

SEQ ID NO: 432 - protein, 8 aa, Artificial Sequence
  Description of Artificial Sequence: Synthetic Peptide
  SITE (7)..(7): Xaa is C, D, F, I, P, Q, T, or Y
AKADISXL

SEQ ID NO: 433 - protein, 8 aa, Artificial Sequence
  Description of Artificial Sequence: Synthetic Peptide
  SITE (7)..(7): Xaa is C, Q, or W
AKADLSXL

SEQ ID NO: 434 - protein, 8 aa, Artificial Sequence
  Description of Artificial Sequence: Synthetic Peptide
  SITE (7)..(7): Xaa is C, F, P, or W
AKAEIDXI

SEQ ID NO: 435 - protein, 8 aa, Artificial Sequence
  Description of Artificial Sequence: Synthetic Peptide
  SITE (7)..(7): Xaa is C, H, M, or P
AKAELDXI

SEQ ID NO: 436 - protein, 8 aa, Artificial Sequence
  Description of Artificial Sequence: Synthetic Peptide
  SITE (7)..(7): Xaa is C or H
AKAEIDXL

SEQ ID NO: 437 - protein, 8 aa, Artificial Sequence
  Description of Artificial Sequence: Synthetic Peptide
  SITE (7)..(7): Xaa is F, C, E, H, I, M, N, Q, W, or Y
AKAELDXL

SEQ ID NO: 438 - protein, 8 aa, Artificial Sequence
  Description of Artificial Sequence: Synthetic Peptide
  SITE (7)..(7): Xaa is C, F, H, I, L, M, P, Q, T, or W
AKAEIRXI

SEQ ID NO: 439 - protein, 8 aa, Artificial Sequence
  Description of Artificial Sequence: Synthetic Peptide
  SITE (7)..(7): Xaa is C, H, I, M, N, P, T, V, W, or Y
AKAELRXI

SEQ ID NO: 440 - protein, 8 aa, Artificial Sequence
  Description of Artificial Sequence: Synthetic Peptide
  SITE (7)..(7): Xaa is C, F, I, P, S, V, or W
AKAEIRXL

SEQ ID NO: 441 - protein, 8 aa, Artificial Sequence
  Description of Artificial Sequence: Synthetic Peptide
  SITE (7)..(7): Xaa is D, H, I, M, W, or Y
AKAELRXL

SEQ ID NO: 442 - protein, 8 aa, Artificial Sequence
  Description of Artificial Sequence: Synthetic Peptide
  SITE (7)..(7): Xaa is G, K, P, R, or T
AKAEISXI

SEQ ID NO: 443 - protein, 8 aa, Artificial Sequence
  Description of Artificial Sequence: Synthetic Peptide
  SITE (7)..(7): Xaa is C, F, H, M, R, or V
AKAELSXI

SEQ ID NO: 444 - protein, 8 aa, Artificial Sequence
  Description of Artificial Sequence: Synthetic Peptide
  SITE (7)..(7): Xaa is F, I, M, N, P, T, or V
AKAEISXL

SEQ ID NO: 445 - protein, 8 aa, Artificial Sequence
  Description of Artificial Sequence: Synthetic Peptide
  SITE (7)..(7): Xaa is C, F, N, P, or W
AKAELSXL

SEQ ID NO: 446 - protein, 8 aa, Artificial Sequence
  Description of Artificial Sequence: Synthetic Peptide
  SITE (7)..(7): Xaa is C, H, K, L, M, N, P, Q, S, W, or Y
AKANIDXI

SEQ ID NO: 447 - protein, 8 aa, Artificial Sequence
  Description of Artificial Sequence: Synthetic Peptide
  SITE (7)..(7): Xaa is C, F, G, H, M, or P
AKANLDXI

SEQ ID NO: 448 - protein, 8 aa, Artificial Sequence
  Description of Artificial Sequence: Synthetic Peptide
  SITE (7)..(7): Xaa is C, L, N, Q, or W
AKANIDXL

SEQ ID NO: 449 - protein, 8 aa, Artificial Sequence
  Description of Artificial Sequence: Synthetic Peptide
  SITE (7)..(7): Xaa is F, M, P, or Q
AKANLDXL

SEQ ID NO: 450 - protein, 8 aa, Artificial Sequence
  Description of Artificial Sequence: Synthetic Peptide
  SITE (7)..(7): Xaa is A, C, D, H, K, L, M, P, Q, R, T, or W
AKANIRXI

SEQ ID NO: 451 - protein, 8 aa, Artificial Sequence
  Description of Artificial Sequence: Synthetic Peptide
  SITE (7)..(7): Xaa is C, G, I, L, M, Q, or Y
AKANLRXI

SEQ ID NO: 452 - protein, 8 aa, Artificial Sequence
  Description of Artificial Sequence: Synthetic Peptide
  SITE (7)..(7): Xaa is A, C, D, E, G, H, K, M, N, P, Q, S, or W
AKANIRXL

SEQ ID NO: 453 - protein, 8 aa, Artificial Sequence
  Description of Artificial Sequence: Synthetic Peptide
  SITE (7)..(7): Xaa is A, C, F, H, I, T, W, or Y
AKANLRXL

SEQ ID NO: 454 - protein, 8 aa, Artificial Sequence
  Description of Artificial Sequence: Synthetic Peptide
  SITE (7)..(7): Xaa is C, F, K, M, P, Q, T, W, or Y
AKANISXI

SEQ ID NO: 455 - protein, 8 aa, Artificial Sequence
  Description of Artificial Sequence: Synthetic Peptide
  SITE (7)..(7): Xaa is C, H, I, M, N, P, T, W, or Y
AKANLSXI

SEQ ID NO: 456 - protein, 8 aa, Artificial Sequence
  Description of Artificial Sequence: Synthetic Peptide
  SITE (7)..(7): Xaa is C, G ,I, L ,M, N, P, S, or T
AKANISXL

SEQ ID NO: 457 - protein, 8 aa, Artificial Sequence
  Description of Artificial Sequence: Synthetic Peptide
  SITE (7)..(7): Xaa is C, F, G, W, or Y
AKANLSXL

SEQ ID NO: 458 - protein, 8 aa, Artificial Sequence
  Description of Artificial Sequence: Synthetic Peptide
  SITE (7)..(7): Xaa is C, E, F, G, H, I, L, M, N, P, R, S, T, W, or Y
AKAQIDXI

SEQ ID NO: 459 - protein, 8 aa, Artificial Sequence
  Description of Artificial Sequence: Synthetic Peptide
  SITE (7)..(7): Xaa is C, F, H, I, P, V, W, or Y
AKAQLDXI

SEQ ID NO: 460 - protein, 8 aa, Artificial Sequence
  Description of Artificial Sequence: Synthetic Peptide
  SITE (7)..(7): Xaa is C, F, H, L, M, P, or W
AKAQIDXL

SEQ ID NO: 461 - protein, 8 aa, Artificial Sequence
  Description of Artificial Sequence: Synthetic Peptide
  SITE (7)..(7): Xaa is C, F, I, M, W
AKAQLDXL

SEQ ID NO: 462 - protein, 8 aa, Artificial Sequence
  Description of Artificial Sequence: Synthetic Peptide
  SITE (7)..(7): Xaa is C, D, H, I, L, M, P, Q, V, W or Y
AKAQIRXI

SEQ ID NO: 463 - protein, 8 aa, Artificial Sequence
  Description of Artificial Sequence: Synthetic Peptide
  SITE (7)..(7): Xaa is C, F, G, I, M, N, P, W, or Y
AKAQLRXI

SEQ ID NO: 464 - protein, 8 aa, Artificial Sequence
  Description of Artificial Sequence: Synthetic Peptide
  SITE (7)..(7): Xaa is C, D, H, I, K, M, N, P, Q, S, T, V, or W
AKAQIRXL

SEQ ID NO: 465 - protein, 8 aa, Artificial Sequence
  Description of Artificial Sequence: Synthetic Peptide
  SITE (7)..(7): Xaa is C, F, I, L, M, Q, V, or W
AKAQLRXL

SEQ ID NO: 466 - protein, 8 aa, Artificial Sequence
  Description of Artificial Sequence: Synthetic Peptide
  SITE (7)..(7): Xaa is C, D, E, F, H, I, M, P, R, V, or Y
AKAQISXI

SEQ ID NO: 467 - protein, 8 aa, Artificial Sequence
  Description of Artificial Sequence: Synthetic Peptide
  SITE (7)..(7): Xaa is C, D, N, T, W, or Y
AKAQLSXI

SEQ ID NO: 468 - protein, 8 aa, Artificial Sequence
  Description of Artificial Sequence: Synthetic Peptide
  SITE (7)..(7): Xaa is C, D, F, H, I, K, M, V, or W
AKAQISXL

SEQ ID NO: 469 - protein, 8 aa, Artificial Sequence
  Description of Artificial Sequence: Synthetic Peptide
  SITE (7)..(7): Xaa is D, F, M, N, W, or Y
AKAQLSXL

SEQ ID NO: 470 - protein, 8 aa, Artificial Sequence
  Description of Artificial Sequence: Synthetic Peptide
  SITE (7)..(7): Xaa is C, F, H, K, P, R, T, V, or W
AKASIDXI

SEQ ID NO: 471 - protein, 8 aa, Artificial Sequence
  Description of Artificial Sequence: Synthetic Peptide
  SITE (7)..(7): Xaa is H, M, P, or W
AKASLDXI

SEQ ID NO: 472 - protein, 8 aa, Artificial Sequence
  Description of Artificial Sequence: Synthetic Peptide
  SITE (7)..(7): Xaa is C, H, M, N, or W
AKASIDXL

SEQ ID NO: 473 - protein, 8 aa, Artificial Sequence
  Description of Artificial Sequence: Synthetic Peptide
  SITE (7)..(7): Xaa is C or Y
AKASLDXL

SEQ ID NO: 474 - protein, 8 aa, Artificial Sequence
  Description of Artificial Sequence: Synthetic Peptide
  SITE (7)..(7): Xaa is A, C, E, G, H, I, L, N, P, Q, R, T, or V
AKASIRXI

SEQ ID NO: 475 - protein, 8 aa, Artificial Sequence
  Description of Artificial Sequence: Synthetic Peptide
  SITE (7)..(7): Xaa is C, H, I, M, P, Q, V, or W
AKASLRXI

SEQ ID NO: 476 - protein, 8 aa, Artificial Sequence
  Description of Artificial Sequence: Synthetic Peptide
  SITE (7)..(7): Xaa is C, F, H, L, P, or W
AKASIRXL

SEQ ID NO: 477 - protein, 8 aa, Artificial Sequence
  Description of Artificial Sequence: Synthetic Peptide
  SITE (7)..(7): Xaa is C, F, M, V, or W
AKASLRXL

SEQ ID NO: 478 - protein, 8 aa, Artificial Sequence
  Description of Artificial Sequence: Synthetic Peptide
  SITE (7)..(7): Xaa is I, L, M, P, Q, W, or Y
AKASISXI

SEQ ID NO: 479 - protein, 8 aa, Artificial Sequence
  Description of Artificial Sequence: Synthetic Peptide
  SITE (7)..(7): Xaa is H, M, N, Q, Y, or W
AKASLSXI

SEQ ID NO: 480 - protein, 8 aa, Artificial Sequence
  Description of Artificial Sequence: Synthetic Peptide
  SITE (7)..(7): Xaa is C, F, I, M, N, R, W, or Y
AKASISXL

SEQ ID NO: 481 - protein, 7 aa, Artificial Sequence
  Description of Artificial Sequence: Synthetic Peptide
  SITE (7)..(7): Xaa is C, M, P, or Y
AKASLSL

SEQ ID NO: 482 - protein, 8 aa, Artificial Sequence
  Description of Artificial Sequence: Synthetic Peptide
  SITE (7)..(7): Xaa is C, E, H, I, L, M, S, or W
AKGDIDXI

SEQ ID NO: 483 - protein, 8 aa, Artificial Sequence
  Description of Artificial Sequence: Synthetic Peptide
  SITE (7)..(7): Xaa is C, F, H, M, N, P, S, W, or Y
AKGDLDXI

SEQ ID NO: 484 - protein, 8 aa, Artificial Sequence
  Description of Artificial Sequence: Synthetic Peptide
  SITE (7)..(7): Xaa is C, E, F, G, H, K, L, M, Q, or Y
AKGDIDXL

SEQ ID NO: 485 - protein, 8 aa, Artificial Sequence
  Description of Artificial Sequence: Synthetic Peptide
  SITE (7)..(7): Xaa is C, H, M, P, Q, W, or Y
AKGDLDXL

SEQ ID NO: 486 - protein, 8 aa, Artificial Sequence
  Description of Artificial Sequence: Synthetic Peptide
  SITE (7)..(7): Xaa is A, C, E, G, H, I, K, L, V, W, or Y
AKGDIRXI

SEQ ID NO: 487 - protein, 8 aa, Artificial Sequence
  Description of Artificial Sequence: Synthetic Peptide
  SITE (7)..(7): Xaa is A, C, D, F, G, H, K, M, P, R, V, W, or Y
AKGDLRXI

SEQ ID NO: 488 - protein, 8 aa, Artificial Sequence
  Description of Artificial Sequence: Synthetic Peptide
  SITE (7)..(7): Xaa is C, E, G, K, M, N, P, Q, R, T, or Y
AKGDIRXL

SEQ ID NO: 489 - protein, 8 aa, Artificial Sequence
  Description of Artificial Sequence: Synthetic Peptide
  SITE (7)..(7): Xaa is C, D, H, K, S, or Y
AKGDLRXL

SEQ ID NO: 490 - protein, 8 aa, Artificial Sequence
  Description of Artificial Sequence: Synthetic Peptide
  SITE (7)..(7): Xaa is E, F, H, M, R, T, V, or W
AKGDISXI

SEQ ID NO: 491 - protein, 8 aa, Artificial Sequence
  Description of Artificial Sequence: Synthetic Peptide
  SITE (7)..(7): Xaa is C, D, H, M, T, or Y
AKGDLSXI

SEQ ID NO: 492 - protein, 8 aa, Artificial Sequence
  Description of Artificial Sequence: Synthetic Peptide
  SITE (7)..(7): Xaa is C, D, H, or W
AKGDISXL

SEQ ID NO: 493 - protein, 8 aa, Artificial Sequence
  Description of Artificial Sequence: Synthetic Peptide
  SITE (7)..(7): Xaa is C, R, or Y
AKGDLSXL

SEQ ID NO: 494 - protein, 8 aa, Artificial Sequence
  Description of Artificial Sequence: Synthetic Peptide
  SITE (7)..(7): Xaa is C, D, M, W, or Y
AKGEIDXI

SEQ ID NO: 495 - protein, 8 aa, Artificial Sequence
  Description of Artificial Sequence: Synthetic Peptide
  SITE (7)..(7): Xaa is C, H, I, M, S, T, W, or Y
AKGELDXI

SEQ ID NO: 496 - protein, 8 aa, Artificial Sequence
  Description of Artificial Sequence: Synthetic Peptide
  SITE (7)..(7): Xaa is D, H, M, S, T, or Y
AKGEIDXL

SEQ ID NO: 497 - protein, 8 aa, Artificial Sequence
  Description of Artificial Sequence: Synthetic Peptide
  SITE (7)..(7): Xaa is D, I, M, or S
AKGELDXL

SEQ ID NO: 498 - protein, 8 aa, Artificial Sequence
  Description of Artificial Sequence: Synthetic Peptide
  SITE (7)..(7): Xaa is E, F, G, K, L, P, T, W, or Y
AKGEIRXI

SEQ ID NO: 499 - protein, 8 aa, Artificial Sequence
  Description of Artificial Sequence: Synthetic Peptide
  SITE (7)..(7): Xaa is D, F, G, K, L, M, N, P, or W
AKGELRXI

SEQ ID NO: 500 - protein, 8 aa, Artificial Sequence
  Description of Artificial Sequence: Synthetic Peptide
  SITE (7)..(7): Xaa is C, D, F, I, M, Q, W, or Y
AKGEIRXL

SEQ ID NO: 501 - protein, 8 aa, Artificial Sequence
  Description of Artificial Sequence: Synthetic Peptide
  SITE (7)..(7): Xaa is C, H, or Q
AKGELRXL

SEQ ID NO: 502 - protein, 8 aa, Artificial Sequence
  Description of Artificial Sequence: Synthetic Peptide
  SITE (7)..(7): Xaa is C, F, H, I, L, M, Q, S, and W
AKGEISXI

SEQ ID NO: 503 - protein, 8 aa, Artificial Sequence
  Description of Artificial Sequence: Synthetic Peptide
  SITE (7)..(7): Xaa is C, D, F, H, M, N, P, Q, T, W, and Y
AKGELSXI

SEQ ID NO: 504 - protein, 8 aa, Artificial Sequence
  Description of Artificial Sequence: Synthetic Peptide
  SITE (7)..(7): Xaa is C, H, K, M, R, T, and W
AKGEISXL

SEQ ID NO: 505 - protein, 8 aa, Artificial Sequence
  Description of Artificial Sequence: Synthetic Peptide
  SITE (7)..(7): Xaa is H, I, M, and V
AKGELSXL

SEQ ID NO: 506 - protein, 8 aa, Artificial Sequence
  Description of Artificial Sequence: Synthetic Peptide
  SITE (7)..(7): Xaa is C, D, G, H, M, N, P, Q, R, S, V, or W
AKGNIDXI

SEQ ID NO: 507 - protein, 8 aa, Artificial Sequence
  Description of Artificial Sequence: Synthetic Peptide
  SITE (7)..(7): Xaa is A, D, E, F, I, M, P, R, S, V, or W
AKGNLDXI

SEQ ID NO: 508 - protein, 8 aa, Artificial Sequence
  Description of Artificial Sequence: Synthetic Peptide
  SITE (7)..(7): Xaa is A, C, H, K, M, N, Q, or T
AKGNIDXL

SEQ ID NO: 509 - protein, 8 aa, Artificial Sequence
  Description of Artificial Sequence: Synthetic Peptide
  SITE (7)..(7): Xaa is C, I, V, or W
AKGNLDXL

SEQ ID NO: 510 - protein, 8 aa, Artificial Sequence
  Description of Artificial Sequence: Synthetic Peptide
  SITE (7)..(7): Xaa is A, C, E, F, H, L, M, N, P, Q, S, or W
AKGNIRXI

SEQ ID NO: 511 - protein, 8 aa, Artificial Sequence
  Description of Artificial Sequence: Synthetic Peptide
  SITE (7)..(7): Xaa is C, D, H, I, K, L, M, N, P, T, V, W, or Y
AKGNLRXI

SEQ ID NO: 512 - protein, 8 aa, Artificial Sequence
  Description of Artificial Sequence: Synthetic Peptide
  SITE (7)..(7): Xaa is A, C, H, K, M, N, P, R, T, W, or Y
AKGNIRXL

SEQ ID NO: 513 - protein, 8 aa, Artificial Sequence
  Description of Artificial Sequence: Synthetic Peptide
  SITE (7)..(7): Xaa is C, F, K, N, P, T, or W
AKGNLRXL

SEQ ID NO: 514 - protein, 8 aa, Artificial Sequence
  Description of Artificial Sequence: Synthetic Peptide
  SITE (7)..(7): Xaa is C, D, E, H, I, M, N, P, V, or W
AKGNISXI

SEQ ID NO: 515 - protein, 8 aa, Artificial Sequence
  Description of Artificial Sequence: Synthetic Peptide
  SITE (7)..(7): Xaa is C, F, H, M, N, P, T, V, or W
AKGNLSXI

SEQ ID NO: 516 - protein, 8 aa, Artificial Sequence
  Description of Artificial Sequence: Synthetic Peptide
  SITE (7)..(7): Xaa is C, D, G, H, K, M, P, Q, or T
AKGNISXL

SEQ ID NO: 517 - protein, 8 aa, Artificial Sequence
  Description of Artificial Sequence: Synthetic Peptide
  SITE (7)..(7): Xaa is D, F, H, M, N, or R
AKGNLSXL

SEQ ID NO: 518 - protein, 8 aa, Artificial Sequence
  Description of Artificial Sequence: Synthetic Peptide
  SITE (7)..(7): Xaa is A, C, E, F, H, K, L, P, T, or W
AKGQIDXI

SEQ ID NO: 519 - protein, 8 aa, Artificial Sequence
  Description of Artificial Sequence: Synthetic Peptide
  SITE (7)..(7): Xaa is C, E, F, G, H, L, M, Q, R, S, T, V, W, or Y
AKGQLDXI

SEQ ID NO: 520 - protein, 8 aa, Artificial Sequence
  Description of Artificial Sequence: Synthetic Peptide
  SITE (7)..(7): Xaa is C, E, M, N, Q, T, or W
AKGQIDXL

SEQ ID NO: 521 - protein, 8 aa, Artificial Sequence
  Description of Artificial Sequence: Synthetic Peptide
  SITE (7)..(7): Xaa is E, F, G, H, M, Q, S, or W
AKGQLDXL

SEQ ID NO: 522 - protein, 8 aa, Artificial Sequence
  Description of Artificial Sequence: Synthetic Peptide
  SITE (7)..(7): Xaa is A, C, E, F, G, H, K, L, P, T, V, W, or Y
AKGQIRXI

SEQ ID NO: 523 - protein, 8 aa, Artificial Sequence
  Description of Artificial Sequence: Synthetic Peptide
  SITE (7)..(7): Xaa is D, L, M, P, S, T, W, or Y
AKGQLRXI

SEQ ID NO: 524 - protein, 8 aa, Artificial Sequence
  Description of Artificial Sequence: Synthetic Peptide
  SITE (7)..(7): Xaa is A, C, D, E, F, H, I, L, N, P, Q, R, S, T, or W
AKGQIRXL

SEQ ID NO: 525 - protein, 8 aa, Artificial Sequence
  Description of Artificial Sequence: Synthetic Peptide
  SITE (7)..(7): Xaa is F, G, H, P, or W
AKGQLRXL

SEQ ID NO: 526 - protein, 8 aa, Artificial Sequence
  Description of Artificial Sequence: Synthetic Peptide
  SITE (7)..(7): Xaa is A, C, E, G, H, K, M, N, R, V, W, or Y
AKGQISXI

SEQ ID NO: 527 - protein, 8 aa, Artificial Sequence
  Description of Artificial Sequence: Synthetic Peptide
  SITE (7)..(7): Xaa is A, C, D, H, L, N, P, Q, R, S, W, or Y
AKGQLSXI

SEQ ID NO: 528 - protein, 8 aa, Artificial Sequence
  Description of Artificial Sequence: Synthetic Peptide
  SITE (7)..(7): Xaa is C, E, F, G, I, K, L, M, P, Q, T, V, W, or Y
AKGQISXL

SEQ ID NO: 529 - protein, 8 aa, Artificial Sequence
  Description of Artificial Sequence: Synthetic Peptide
  SITE (7)..(7): Xaa is F, H, M, V, W, or Y
AKGQLSXL

SEQ ID NO: 530 - protein, 8 aa, Artificial Sequence
  Description of Artificial Sequence: Synthetic Peptide
  SITE (7)..(7): Xaa is A, C, F, I, K, M, N, P, R, S, T, W, or Y
AKGSIDXI

SEQ ID NO: 531 - protein, 8 aa, Artificial Sequence
  Description of Artificial Sequence: Synthetic Peptide
  SITE (7)..(7): Xaa is D, M, P, R, T, or W
AKGSLDXI

SEQ ID NO: 532 - protein, 8 aa, Artificial Sequence
  Description of Artificial Sequence: Synthetic Peptide
  SITE (7)..(7): Xaa is A, C, F, K, P, Q, R, or T
AKGSIDXL

SEQ ID NO: 533 - protein, 8 aa, Artificial Sequence
  Description of Artificial Sequence: Synthetic Peptide
  SITE (7)..(7): Xaa is C, F, M, P, V, or Y
AKGSLDXL

SEQ ID NO: 534 - protein, 8 aa, Artificial Sequence
  Description of Artificial Sequence: Synthetic Peptide
  SITE (7)..(7): Xaa is A, C, D, G, H, I, K, L, M, P, Q, R, T, W, or Y
AKGSIRXI

SEQ ID NO: 535 - protein, 8 aa, Artificial Sequence
  Description of Artificial Sequence: Synthetic Peptide
  SITE (7)..(7): Xaa is A, F, G, H, I, K, L, M, N, Q, W, or Y
AKGSLRXI

SEQ ID NO: 536 - protein, 8 aa, Artificial Sequence
  Description of Artificial Sequence: Synthetic Peptide
  SITE (7)..(7): Xaa is C, D, E, H, I, L, M, N, P, R, T, V, W, or Y
AKGSIRXL

SEQ ID NO: 537 - protein, 8 aa, Artificial Sequence
  Description of Artificial Sequence: Synthetic Peptide
  SITE (7)..(7): Xaa is C, F, G, H, K, M, T, or Y
AKGSLRXL

SEQ ID NO: 538 - protein, 8 aa, Artificial Sequence
  Description of Artificial Sequence: Synthetic Peptide
  SITE (7)..(7): Xaa is A, C, F, I, K, M, N, P, R, S, T, W, or Y
AKGSISXI

SEQ ID NO: 539 - protein, 8 aa, Artificial Sequence
  Description of Artificial Sequence: Synthetic Peptide
  SITE (7)..(7): Xaa is C, E, H, I, K, N, P, S, or T
AKGSLSXI

SEQ ID NO: 540 - protein, 8 aa, Artificial Sequence
  Description of Artificial Sequence: Synthetic Peptide
  SITE (7)..(7): Xaa is C, D, E, H, I, L, M, N, P, R, T, V, W, or Y
AKGSISXL

SEQ ID NO: 541 - protein, 8 aa, Artificial Sequence
  Description of Artificial Sequence: Synthetic Peptide
  SITE (7)..(7): Xaa is H, M, N, or P
AKGSLSXL

SEQ ID NO: 542 - protein, 8 aa, Artificial Sequence
  Description of Artificial Sequence: Synthetic Peptide
  SITE (7)..(7): Xaa is C, D, E, H, N, or W
AKLDIDXI

SEQ ID NO: 543 - protein, 8 aa, Artificial Sequence
  Description of Artificial Sequence: Synthetic Peptide
  SITE (7)..(7): Xaa is G, H, I, M, T, V, or W
AKLDLDXI

SEQ ID NO: 544 - protein, 8 aa, Artificial Sequence
  Description of Artificial Sequence: Synthetic Peptide
  SITE (7)..(7): Xaa is C, H, N, P, Q. or S
AKLDIDXL

SEQ ID NO: 545 - protein, 8 aa, Artificial Sequence
  Description of Artificial Sequence: Synthetic Peptide
  SITE (7)..(7): Xaa is C, H, or I
AKLDLDXL

SEQ ID NO: 546 - protein, 8 aa, Artificial Sequence
  Description of Artificial Sequence: Synthetic Peptide
  SITE (7)..(7): Xaa is A, C, E, G, H, L, P, Q, R, W, or Y
AKLDIRXI

SEQ ID NO: 547 - protein, 8 aa, Artificial Sequence
  Description of Artificial Sequence: Synthetic Peptide
  SITE (7)..(7): Xaa is A, C, E, H, I, N, P, Q, or W
AKLDLRXI

SEQ ID NO: 548 - protein, 8 aa, Artificial Sequence
  Description of Artificial Sequence: Synthetic Peptide
  SITE (7)..(7): Xaa is C, D, G, H, P, Q, S, W, or Y
AKLDIRXL

SEQ ID NO: 549 - protein, 8 aa, Artificial Sequence
  Description of Artificial Sequence: Synthetic Peptide
  SITE (7)..(7): Xaa is C, D, K, M, N, S, or W
AKLDLRXL

SEQ ID NO: 550 - protein, 8 aa, Artificial Sequence
  Description of Artificial Sequence: Synthetic Peptide
  SITE (7)..(7): Xaa is C, D, H, I, K, M, N, w, or Y
AKLDISXI

SEQ ID NO: 551 - protein, 8 aa, Artificial Sequence
  Description of Artificial Sequence: Synthetic Peptide
  SITE (7)..(7): Xaa is C, F, H, I, M, or W
AKLDLSXI

SEQ ID NO: 552 - protein, 8 aa, Artificial Sequence
  Description of Artificial Sequence: Synthetic Peptide
  SITE (7)..(7): Xaa is C, F, H, M ,V, or Y
AKLDISXL

SEQ ID NO: 553 - protein, 8 aa, Artificial Sequence
  Description of Artificial Sequence: Synthetic Peptide
  SITE (7)..(7): Xaa is I, C, D, E, F, G, H, L, M, P, W, or Y
AKLDLSXL

SEQ ID NO: 554 - protein, 8 aa, Artificial Sequence
  Description of Artificial Sequence: Synthetic Peptide
  SITE (7)..(7): Xaa is C, F, R, T, V, W, or Y
AKLEIDXI

SEQ ID NO: 555 - protein, 8 aa, Artificial Sequence
  Description of Artificial Sequence: Synthetic Peptide
  SITE (7)..(7): Xaa is C, I, K, L, M, P, T, V, or W
AKLELDXI

SEQ ID NO: 556 - protein, 8 aa, Artificial Sequence
  Description of Artificial Sequence: Synthetic Peptide
  SITE (7)..(7): Xaa is C, F, P, Q, W, or Y
AKLEIDXL

SEQ ID NO: 557 - protein, 8 aa, Artificial Sequence
  Description of Artificial Sequence: Synthetic Peptide
  SITE (7)..(7): Xaa is C, H, M, N, P, S, or W
AKLELDXL

SEQ ID NO: 558 - protein, 8 aa, Artificial Sequence
  Description of Artificial Sequence: Synthetic Peptide
  SITE (7)..(7): Xaa is A, C, G, H, I, K, M, P, Q, R, S, T, V, W, or Y
AKLEIRXI

SEQ ID NO: 559 - protein, 8 aa, Artificial Sequence
  Description of Artificial Sequence: Synthetic Peptide
  SITE (7)..(7): Xaa is C, F, G, I, L, M, Q, S, T, V, W, or Y
AKLELRXI

SEQ ID NO: 560 - protein, 8 aa, Artificial Sequence
  Description of Artificial Sequence: Synthetic Peptide
  SITE (7)..(7): Xaa is C, G, M, Q, R, V, W, or Y
AKLEIRXL

SEQ ID NO: 561 - protein, 8 aa, Artificial Sequence
  Description of Artificial Sequence: Synthetic Peptide
  SITE (7)..(7): Xaa is C, F, G, H, L, M, Q, or W
AKLELRXL

SEQ ID NO: 562 - protein, 8 aa, Artificial Sequence
  Description of Artificial Sequence: Synthetic Peptide
  SITE (7)..(7): Xaa is C, G, H, I, K, L, M, P, T, V, or W
AKLEISXI

SEQ ID NO: 563 - protein, 8 aa, Artificial Sequence
  Description of Artificial Sequence: Synthetic Peptide
  SITE (7)..(7): Xaa is A, C, E, F, H, L, M, N, T, W, or Y
AKLELSXI

SEQ ID NO: 564 - protein, 8 aa, Artificial Sequence
  Description of Artificial Sequence: Synthetic Peptide
  SITE (7)..(7): Xaa is A, C, D, E, H, M, N, P, or W
AKLEISXL

SEQ ID NO: 565 - protein, 8 aa, Artificial Sequence
  Description of Artificial Sequence: Synthetic Peptide
  SITE (7)..(7): Xaa is F, G, M ,P, Q, or W
AKLELSXL

SEQ ID NO: 566 - protein, 8 aa, Artificial Sequence
  Description of Artificial Sequence: Synthetic Peptide
  SITE (7)..(7): Xaa is C, E, H, R, or W
AKLNIDXI

SEQ ID NO: 567 - protein, 8 aa, Artificial Sequence
  Description of Artificial Sequence: Synthetic Peptide
  SITE (7)..(7): Xaa is F, H, I, K, T, V, or W
AKLNLDXI

SEQ ID NO: 568 - protein, 8 aa, Artificial Sequence
  Description of Artificial Sequence: Synthetic Peptide
  SITE (7)..(7): Xaa is C, D, F, H, L, or P
AKLNIDXL

SEQ ID NO: 569 - protein, 8 aa, Artificial Sequence
  Description of Artificial Sequence: Synthetic Peptide
  SITE (7)..(7): Xaa is C, F, H, W, or Y
AKLNLDXL

SEQ ID NO: 570 - protein, 8 aa, Artificial Sequence
  Description of Artificial Sequence: Synthetic Peptide
  SITE (7)..(7): Xaa is C, H, I, K, L, M, P, Q, T, or Y
AKLNIRXI

SEQ ID NO: 571 - protein, 8 aa, Artificial Sequence
  Description of Artificial Sequence: Synthetic Peptide
  SITE (7)..(7): Xaa is C, F, I, K, L, M, N, Q, S, V, W, or Y
AKLNLRXI

SEQ ID NO: 572 - protein, 8 aa, Artificial Sequence
  Description of Artificial Sequence: Synthetic Peptide
  SITE (7)..(7): Xaa is C, D, F, G, H, I, K, L, M, M, P, R, S, T, V, W, or Y
AKLNIRXL

SEQ ID NO: 573 - protein, 8 aa, Artificial Sequence
  Description of Artificial Sequence: Synthetic Peptide
  SITE (7)..(7): Xaa is C, D, G, H, I ,K, M, N, or Y
AKLNLRXL

SEQ ID NO: 574 - protein, 8 aa, Artificial Sequence
  Description of Artificial Sequence: Synthetic Peptide
  SITE (7)..(7): Xaa is A, C, E, I, L, M, Q, T, W, or Y
AKLNISXI

SEQ ID NO: 575 - protein, 8 aa, Artificial Sequence
  Description of Artificial Sequence: Synthetic Peptide
  SITE (7)..(7): Xaa is C, D, M, R, v ,W, or Y
AKLNLSXI

SEQ ID NO: 576 - protein, 8 aa, Artificial Sequence
  Description of Artificial Sequence: Synthetic Peptide
  SITE (7)..(7): Xaa is C, F, H, M, R, or W
AKLNISXL

SEQ ID NO: 577 - protein, 8 aa, Artificial Sequence
  Description of Artificial Sequence: Synthetic Peptide
  SITE (7)..(7): Xaa is C, M, R, T ,V, or W
AKLNLSXL

SEQ ID NO: 578 - protein, 8 aa, Artificial Sequence
  Description of Artificial Sequence: Synthetic Peptide
  SITE (7)..(7): Xaa is A, C, E, F, G, H, I, L, M, N, Q, T, V, W, or Y
AKLQIDXI

SEQ ID NO: 579 - protein, 8 aa, Artificial Sequence
  Description of Artificial Sequence: Synthetic Peptide
  SITE (7)..(7): Xaa is C, F, I, M, N, P, Q, R, V, or W
AKLQLDXI

SEQ ID NO: 580 - protein, 8 aa, Artificial Sequence
  Description of Artificial Sequence: Synthetic Peptide
  SITE (7)..(7): Xaa is C, E, F, H, I, K, M, P, Q, V, W, or Y
AKLQIDXL

SEQ ID NO: 581 - protein, 8 aa, Artificial Sequence
  Description of Artificial Sequence: Synthetic Peptide
  SITE (7)..(7): Xaa is C, E, F, G, H, M, P, or S
AKLQLDXL

SEQ ID NO: 582 - protein, 8 aa, Artificial Sequence
  Description of Artificial Sequence: Synthetic Peptide
  SITE (7)..(7): Xaa is C, F, G, H, I, L, M, N, P, Q, S, T, V, W, or Y
AKLQIRXI

SEQ ID NO: 583 - protein, 8 aa, Artificial Sequence
  Description of Artificial Sequence: Synthetic Peptide
  SITE (7)..(7): Xaa is A, C, D, E, F, H, I, K, L, M, P, Q, R, S, V, W, or Y
AKLQLRXI

SEQ ID NO: 584 - protein, 8 aa, Artificial Sequence
  Description of Artificial Sequence: Synthetic Peptide
  SITE (7)..(7): Xaa is C, D, E, G, H, I, K, L, M, P, Q, R, W, or Y
AKLQIRXL

SEQ ID NO: 585 - protein, 8 aa, Artificial Sequence
  Description of Artificial Sequence: Synthetic Peptide
  SITE (7)..(7): Xaa is C, D, F, H, M, N, P, R, S, T, V, W, or Y
AKLQLRXL

SEQ ID NO: 586 - protein, 8 aa, Artificial Sequence
  Description of Artificial Sequence: Synthetic Peptide
  SITE (7)..(7): Xaa is C, E, I, L, M, N, R, S, T, V, or W
AKLQISXI

SEQ ID NO: 587 - protein, 8 aa, Artificial Sequence
  Description of Artificial Sequence: Synthetic Peptide
  SITE (7)..(7): Xaa is C, F, H, I, K, M, N, P, V, W, or Y
AKLQLSXI

SEQ ID NO: 588 - protein, 8 aa, Artificial Sequence
  Description of Artificial Sequence: Synthetic Peptide
  SITE (7)..(7): Xaa is C, D, F, G ,I, K, M, N, Q, S, T, W, or Y
AKLQISXL

SEQ ID NO: 589 - protein, 8 aa, Artificial Sequence
  Description of Artificial Sequence: Synthetic Peptide
  SITE (7)..(7): Xaa is C, S, H, V, W, or Y
AKLQLSXL

SEQ ID NO: 590 - protein, 8 aa, Artificial Sequence
  Description of Artificial Sequence: Synthetic Peptide
  SITE (7)..(7): Xaa is C, H, I, L, or W
AKLSIDXI

SEQ ID NO: 591 - protein, 8 aa, Artificial Sequence
  Description of Artificial Sequence: Synthetic Peptide
  SITE (7)..(7): Xaa is H, M, V, or W
AKLSLDXI

SEQ ID NO: 592 - protein, 8 aa, Artificial Sequence
  Description of Artificial Sequence: Synthetic Peptide
  SITE (7)..(7): Xaa is C, F, K, M, or W
AKLSIDXL

SEQ ID NO: 593 - protein, 8 aa, Artificial Sequence
  Description of Artificial Sequence: Synthetic Peptide
  SITE (7)..(7): Xaa is F, A, C, I, K, L, W, or Y
AKLSLDXL

SEQ ID NO: 594 - protein, 8 aa, Artificial Sequence
  Description of Artificial Sequence: Synthetic Peptide
  SITE (7)..(7): Xaa is A, C, F, K, M, N, P, Q, T, V, W, or Y
AKLSIRXI

SEQ ID NO: 595 - protein, 8 aa, Artificial Sequence
  Description of Artificial Sequence: Synthetic Peptide
  SITE (7)..(7): Xaa is A, C, E, F, H, I, L, N, S, T, W, or Y
AKLSLRXI

SEQ ID NO: 596 - protein, 8 aa, Artificial Sequence
  Description of Artificial Sequence: Synthetic Peptide
  SITE (7)..(7): Xaa is C, G, N, R, S, W, or Y
AKLSIRXL

SEQ ID NO: 597 - protein, 8 aa, Artificial Sequence
  Description of Artificial Sequence: Synthetic Peptide
  SITE (7)..(7): Xaa is C, F, W, or Y
AKLSLRXL

SEQ ID NO: 598 - protein, 8 aa, Artificial Sequence
  Description of Artificial Sequence: Synthetic Peptide
  SITE (7)..(7): Xaa is C, H, M, N, R, or W
AKLSLSXI

SEQ ID NO: 599 - protein, 8 aa, Artificial Sequence
  Description of Artificial Sequence: Synthetic Peptide
  SITE (7)..(7): Xaa is C, P, or W
AKLSISXL

SEQ ID NO: 600 - protein, 8 aa, Artificial Sequence
  Description of Artificial Sequence: Synthetic Peptide
  SITE (7)..(7): Xaa is C, H, Q, or W
AKLSLSXL

SEQ ID NO: 601 - protein, 8 aa, Artificial Sequence
  Description of Artificial Sequence: Synthetic Peptide
  SITE (7)..(7): Xaa is A, C, D, F, G, H, K, L, M, N, P, Q, R, S, or W
AKNDIDXI

SEQ ID NO: 602 - protein, 8 aa, Artificial Sequence
  Description of Artificial Sequence: Synthetic Peptide
  SITE (7)..(7): Xaa is C, D, F, G, M, N, P, S, or W
AKNDLDXI

SEQ ID NO: 603 - protein, 8 aa, Artificial Sequence
  Description of Artificial Sequence: Synthetic Peptide
  SITE (7)..(7): Xaa is C, E, H, N, P, Q, R, S, or W
AKNDIDXL

SEQ ID NO: 604 - protein, 8 aa, Artificial Sequence
  Description of Artificial Sequence: Synthetic Peptide
  SITE (7)..(7): Xaa is C, D, F ,H ,L, M, T, V, or Y
AKNDLDXL

SEQ ID NO: 605 - protein, 8 aa, Artificial Sequence
  Description of Artificial Sequence: Synthetic Peptide
  SITE (7)..(7): Xaa is A, C, D, F, G, H, M, N, P, R, T, V, W, or Y
AKNDIRXI

SEQ ID NO: 606 - protein, 8 aa, Artificial Sequence
  Description of Artificial Sequence: Synthetic Peptide
  SITE (7)..(7): Xaa is C, D, E, H, L, M, N, Q, S, V, W, or Y
AKNDLRXI

SEQ ID NO: 607 - protein, 8 aa, Artificial Sequence
  Description of Artificial Sequence: Synthetic Peptide
  SITE (7)..(7): Xaa is C, D, F, G, H, M, P, R, T, W, or Y
AKNDIRXL

SEQ ID NO: 608 - protein, 8 aa, Artificial Sequence
  Description of Artificial Sequence: Synthetic Peptide
  SITE (7)..(7): Xaa is C, F, H, L, M, N, P, Q, R, S, V, W, or Y
AKNDLRXL

SEQ ID NO: 609 - protein, 8 aa, Artificial Sequence
  Description of Artificial Sequence: Synthetic Peptide
  SITE (7)..(7): Xaa is A, C, D, F ,H, I, L, M, P, Q, R, S, W, or Y
AKNDISXI

SEQ ID NO: 610 - protein, 8 aa, Artificial Sequence
  Description of Artificial Sequence: Synthetic Peptide
  SITE (7)..(7): Xaa is C, D, G, H, L, M, P, Q, R, V, or W
AKNDLSXI

SEQ ID NO: 611 - protein, 8 aa, Artificial Sequence
  Description of Artificial Sequence: Synthetic Peptide
  SITE (7)..(7): Xaa is C, F, H, I, M, P, Q, S, V, W, or Y
AKNDISXL

SEQ ID NO: 612 - protein, 8 aa, Artificial Sequence
  Description of Artificial Sequence: Synthetic Peptide
  SITE (7)..(7): Xaa is C, G, H, M, N, Q, V, W, or Y
AKNDLSXL

SEQ ID NO: 613 - protein, 8 aa, Artificial Sequence
  Description of Artificial Sequence: Synthetic Peptide
  SITE (7)..(7): Xaa is A, C, E, G, I, M, P, Q, P, or Y
AKNEIDXI

SEQ ID NO: 614 - protein, 8 aa, Artificial Sequence
  Description of Artificial Sequence: Synthetic Peptide
  SITE (7)..(7): Xaa is A, C, F, G, H, I, L, M, P, S, V, W, or Y
AKNELDXI

SEQ ID NO: 615 - protein, 8 aa, Artificial Sequence
  Description of Artificial Sequence: Synthetic Peptide
  SITE (7)..(7): Xaa is A, C, K, P, Q, T, or W
AKNEIDXL

SEQ ID NO: 616 - protein, 8 aa, Artificial Sequence
  Description of Artificial Sequence: Synthetic Peptide
  SITE (7)..(7): Xaa is A, G, H, N, or W
AKNELDXL

SEQ ID NO: 617 - protein, 8 aa, Artificial Sequence
  Description of Artificial Sequence: Synthetic Peptide
  SITE (7)..(7): Xaa is C, E, I, L, N, P, T, V, or W
AKNELRXI

SEQ ID NO: 618 - protein, 8 aa, Artificial Sequence
  Description of Artificial Sequence: Synthetic Peptide
  SITE (7)..(7): Xaa is C, F, H, K, L, M, N, Q, R, V, or W
AKNEIRXL

SEQ ID NO: 619 - protein, 8 aa, Artificial Sequence
  Description of Artificial Sequence: Synthetic Peptide
  SITE (7)..(7): Xaa is C, D, G, H ,I, K, P, Q, V, or Y
AKNELRXL

SEQ ID NO: 620 - protein, 8 aa, Artificial Sequence
  Description of Artificial Sequence: Synthetic Peptide
  SITE (7)..(7): Xaa is C, D, E, F, H, I, M, P, R, W, or Y
AKNEISXI

SEQ ID NO: 621 - protein, 8 aa, Artificial Sequence
  Description of Artificial Sequence: Synthetic Peptide
  SITE (7)..(7): Xaa is A, C, F, H, P, V, or W
AKNELSXI

SEQ ID NO: 622 - protein, 8 aa, Artificial Sequence
  Description of Artificial Sequence: Synthetic Peptide
  SITE (7)..(7): Xaa is C, D, F, K, M, N, P, T, or W
AKNEISXL

SEQ ID NO: 623 - protein, 8 aa, Artificial Sequence
  Description of Artificial Sequence: Synthetic Peptide
  SITE (7)..(7): Xaa is C, H, S, or W
AKNELSXL

SEQ ID NO: 624 - protein, 8 aa, Artificial Sequence
  Description of Artificial Sequence: Synthetic Peptide
  SITE (7)..(7): Xaa is A, C, E, F, H, I, M, P, S, or W
AKNNIDXI

SEQ ID NO: 625 - protein, 8 aa, Artificial Sequence
  Description of Artificial Sequence: Synthetic Peptide
  SITE (7)..(7): Xaa is C, E, F, G, H, M, P, Q, R, S, W, or Y
AKNNLDXI

SEQ ID NO: 626 - protein, 8 aa, Artificial Sequence
  Description of Artificial Sequence: Synthetic Peptide
  SITE (7)..(7): Xaa is E, H,  M, Q, S, or W
AKNNIDXL

SEQ ID NO: 627 - protein, 8 aa, Artificial Sequence
  Description of Artificial Sequence: Synthetic Peptide
  SITE (7)..(7): Xaa is C, D, E, F, I, L, M, P, W, and Y
AKNNLDXL

SEQ ID NO: 628 - protein, 8 aa, Artificial Sequence
  Description of Artificial Sequence: Synthetic Peptide
  SITE (7)..(7): Xaa is C, D, E, G, K, M, N, Q, R, S, T, W, or Y
AKNNIRXI

SEQ ID NO: 629 - protein, 8 aa, Artificial Sequence
  Description of Artificial Sequence: Synthetic Peptide
  SITE (7)..(7): Xaa is C, D, E, F, G, I, L, M, Q, R, T, or W
AKNNLRXI

SEQ ID NO: 630 - protein, 8 aa, Artificial Sequence
  Description of Artificial Sequence: Synthetic Peptide
  SITE (7)..(7): Xaa is C, D, E, F, G, H, N, P, Q, T, W, or Y
AKNNIRXL

SEQ ID NO: 631 - protein, 8 aa, Artificial Sequence
  Description of Artificial Sequence: Synthetic Peptide
  SITE (7)..(7): Xaa is C, E, F, H, M, T, W, or Y
AKNNLRXL

SEQ ID NO: 632 - protein, 8 aa, Artificial Sequence
  Description of Artificial Sequence: Synthetic Peptide
  SITE (7)..(7): Xaa is C, D, F, H, M, R, V, W, or Y
AKNNISXI

SEQ ID NO: 633 - protein, 8 aa, Artificial Sequence
  Description of Artificial Sequence: Synthetic Peptide
  SITE (7)..(7): Xaa is A, C, E, F, I, M, N, P, Q, S, or W
AKNNLSXI

SEQ ID NO: 634 - protein, 8 aa, Artificial Sequence
  Description of Artificial Sequence: Synthetic Peptide
  SITE (7)..(7): Xaa is C, E, G, H, K, M, N, P, R, W, or Y
AKNNISXL

SEQ ID NO: 635 - protein, 8 aa, Artificial Sequence
  Description of Artificial Sequence: Synthetic Peptide
  SITE (7)..(7): Xaa is C, F, H, P, T, V, W, or Y
AKNNLSXL

SEQ ID NO: 636 - protein, 8 aa, Artificial Sequence
  Description of Artificial Sequence: Synthetic Peptide
  SITE (7)..(7): Xaa is A, C, D, E, F, G, H, I, K, L, M, N, P, Q, R, S, T, V, or W
AKNQIDXI

SEQ ID NO: 637 - protein, 8 aa, Artificial Sequence
  Description of Artificial Sequence: Synthetic Peptide
  SITE (7)..(7): Xaa is A, C, E, F, G, H, I, K, M, N, P, T, W, or Y
AKNQLDXI

SEQ ID NO: 638 - protein, 8 aa, Artificial Sequence
  Description of Artificial Sequence: Synthetic Peptide
  SITE (7)..(7): Xaa is C, F, G, H, K, M, N, R, T, or W
AKNQIDXL

SEQ ID NO: 639 - protein, 8 aa, Artificial Sequence
  Description of Artificial Sequence: Synthetic Peptide
  SITE (7)..(7): Xaa is C, E, F, M, R, or T
AKNQLDXL

SEQ ID NO: 640 - protein, 8 aa, Artificial Sequence
  Description of Artificial Sequence: Synthetic Peptide
  SITE (7)..(7): Xaa is C, D, E, I, L, M, N, P, Q, R, T, v, W, or Y
AKNQIRXI

SEQ ID NO: 641 - protein, 8 aa, Artificial Sequence
  Description of Artificial Sequence: Synthetic Peptide
  SITE (7)..(7): Xaa is C, F, G, H, I, K, L, M, N, P, Q, R, S, T, W, or Y
AKNQLRXI

SEQ ID NO: 642 - protein, 8 aa, Artificial Sequence
  Description of Artificial Sequence: Synthetic Peptide
  SITE (7)..(7): Xaa is A, C, D, E, G, H, I, K, M, P, Q, S, T, W, or Y
AKNQIRXL

SEQ ID NO: 643 - protein, 8 aa, Artificial Sequence
  Description of Artificial Sequence: Synthetic Peptide
  SITE (7)..(7): Xaa is C, E, F, G, H, I, K, M, P, Q, T, V, W, or Y
AKNQLRXL

SEQ ID NO: 644 - protein, 8 aa, Artificial Sequence
  Description of Artificial Sequence: Synthetic Peptide
  SITE (7)..(7): Xaa is A, D, F, G, H, I, N, P, Q, R, V, W, or Y
AKNQISXI

SEQ ID NO: 645 - protein, 8 aa, Artificial Sequence
  Description of Artificial Sequence: Synthetic Peptide
  SITE (7)..(7): Xaa is C, D, E, F, H, I, M, P, Q, R, T, or W
AKNQLSXI

SEQ ID NO: 646 - protein, 8 aa, Artificial Sequence
  Description of Artificial Sequence: Synthetic Peptide
  SITE (7)..(7): Xaa is C, F, H, K, L, M, Q, W, or Y
AKNQISXL

SEQ ID NO: 647 - protein, 8 aa, Artificial Sequence
  Description of Artificial Sequence: Synthetic Peptide
  SITE (7)..(7): Xaa is F, G, I, M, T, or W
AKNQLSXL

SEQ ID NO: 648 - protein, 8 aa, Artificial Sequence
  Description of Artificial Sequence: Synthetic Peptide
  SITE (7)..(7): Xaa is A, C, G, H, M, P, or W
AKNSIDXI

SEQ ID NO: 649 - protein, 8 aa, Artificial Sequence
  Description of Artificial Sequence: Synthetic Peptide
  SITE (7)..(7): Xaa is A, C, F, H, M, V, or W
AKNSLDXI

SEQ ID NO: 650 - protein, 8 aa, Artificial Sequence
  Description of Artificial Sequence: Synthetic Peptide
  SITE (7)..(7): Xaa is C, G, H, I, M, P, Q, R, or W
AKNSIDXL

SEQ ID NO: 651 - protein, 8 aa, Artificial Sequence
  Description of Artificial Sequence: Synthetic Peptide
  SITE (7)..(7): Xaa is C, H, N, T, V, or Y
AKNSLDXL

SEQ ID NO: 652 - protein, 8 aa, Artificial Sequence
  Description of Artificial Sequence: Synthetic Peptide
  SITE (7)..(7): Xaa is C, F, G, H, I, K, L, M, N, P, V, W, or Y
AKNSIRXI

SEQ ID NO: 653 - protein, 8 aa, Artificial Sequence
  Description of Artificial Sequence: Synthetic Peptide
  SITE (7)..(7): Xaa is A, C, D, I, K, L, M, N, P, Q, S, T, V, or W
AKNSLRXI

SEQ ID NO: 654 - protein, 8 aa, Artificial Sequence
  Description of Artificial Sequence: Synthetic Peptide
  SITE (7)..(7): Xaa is E, F, G, H, I, L, M, P, Q, T, W, or Y
AKNSIRXL

SEQ ID NO: 655 - protein, 8 aa, Artificial Sequence
  Description of Artificial Sequence: Synthetic Peptide
  SITE (7)..(7): Xaa is A, C, F, G, P, T, or W
AKNSLRXL

SEQ ID NO: 656 - protein, 8 aa, Artificial Sequence
  Description of Artificial Sequence: Synthetic Peptide
  SITE (7)..(7): Xaa is C,E, F, H, L, M, N, Q, W, or Y
AKNSLSXI

SEQ ID NO: 657 - protein, 8 aa, Artificial Sequence
  Description of Artificial Sequence: Synthetic Peptide
  SITE (7)..(7): Xaa is G, K, L, M, P, R, S, or W
AKNSISXL

SEQ ID NO: 658 - protein, 8 aa, Artificial Sequence
  Description of Artificial Sequence: Synthetic Peptide
  SITE (7)..(7): Xaa is C, D, F, G, N, or Q
AKNSLSXL

SEQ ID NO: 659 - protein, 8 aa, Artificial Sequence
  Description of Artificial Sequence: Synthetic Peptide
  SITE (7)..(7): Xaa is D, K, M, N, P, Q, R, or T
AKSDIDXI

SEQ ID NO: 660 - protein, 8 aa, Artificial Sequence
  Description of Artificial Sequence: Synthetic Peptide
  SITE (7)..(7): Xaa is A, C, D, H, M, T, V, W, or Y
AKSDLDXI

SEQ ID NO: 661 - protein, 8 aa, Artificial Sequence
  Description of Artificial Sequence: Synthetic Peptide
  SITE (7)..(7): Xaa is E, I, K, M, T, or Y
AKSDIDXL

SEQ ID NO: 662 - protein, 8 aa, Artificial Sequence
  Description of Artificial Sequence: Synthetic Peptide
  SITE (7)..(7): Xaa is C, D, H, M, P, or S
AKSDLDXL

SEQ ID NO: 663 - protein, 8 aa, Artificial Sequence
  Description of Artificial Sequence: Synthetic Peptide
  SITE (7)..(7): Xaa is A, C, D, H, K, M, P, R, T, V, W, or Y
AKSDIRXI

SEQ ID NO: 664 - protein, 8 aa, Artificial Sequence
  Description of Artificial Sequence: Synthetic Peptide
  SITE (7)..(7): Xaa is C, G, I, L, N, P, Q, S, T, V, or Y
AKSDLRXI

SEQ ID NO: 665 - protein, 8 aa, Artificial Sequence
  Description of Artificial Sequence: Synthetic Peptide
  SITE (7)..(7): Xaa is A, F, G, H, I, L, M, N, R, S, T, V, or W
AKSDIRXL

SEQ ID NO: 666 - protein, 8 aa, Artificial Sequence
  Description of Artificial Sequence: Synthetic Peptide
  SITE (7)..(7): Xaa is A, C, E, F, G, H, M, N, P, Q, T, W, or Y
AKSDLRXL

SEQ ID NO: 667 - protein, 8 aa, Artificial Sequence
  Description of Artificial Sequence: Synthetic Peptide
  SITE (7)..(7): Xaa is A, C, D, E, F, G, H,I, K, L, M, P, Q, or R
AKSDISXI

SEQ ID NO: 668 - protein, 8 aa, Artificial Sequence
  Description of Artificial Sequence: Synthetic Peptide
  SITE (7)..(7): Xaa is A, C, D, E, F, G, I, M, or W
AKSDLSXI

SEQ ID NO: 669 - protein, 8 aa, Artificial Sequence
  Description of Artificial Sequence: Synthetic Peptide
  SITE (7)..(7): Xaa is C, G, I, P, W, or Y
AKSDISXL

SEQ ID NO: 670 - protein, 8 aa, Artificial Sequence
  Description of Artificial Sequence: Synthetic Peptide
  SITE (7)..(7): Xaa is C, I, M, or Y
AKSDLSXL

SEQ ID NO: 671 - protein, 8 aa, Artificial Sequence
  Description of Artificial Sequence: Synthetic Peptide
  SITE (7)..(7): Xaa is C, I, M, N, P, Q, T, V, W, or Y
AKSEIDXI

SEQ ID NO: 672 - protein, 8 aa, Artificial Sequence
  Description of Artificial Sequence: Synthetic Peptide
  SITE (7)..(7): Xaa is C, D, G, H, I, M, N, P, R, V, W, or Y
AKSELDXI

SEQ ID NO: 673 - protein, 8 aa, Artificial Sequence
  Description of Artificial Sequence: Synthetic Peptide
  SITE (7)..(7): Xaa is C, F, or L
AKSEIDXL

SEQ ID NO: 674 - protein, 8 aa, Artificial Sequence
  Description of Artificial Sequence: Synthetic Peptide
  SITE (7)..(7): Xaa is H, L, P, or Y
AKSELDXL

SEQ ID NO: 675 - protein, 8 aa, Artificial Sequence
  Description of Artificial Sequence: Synthetic Peptide
  SITE (7)..(7): Xaa is C, F, G, I, K, Q, R, S, or Y
AKSEIRXI

SEQ ID NO: 676 - protein, 8 aa, Artificial Sequence
  Description of Artificial Sequence: Synthetic Peptide
  SITE (7)..(7): Xaa is C, F, G, H, K, L, M, P, V, W, or Y
AKSELRXI

SEQ ID NO: 677 - protein, 8 aa, Artificial Sequence
  Description of Artificial Sequence: Synthetic Peptide
  SITE (7)..(7): Xaa is C, D, H, I, K, M, P, Q, T, V, W, or Y
AKSEIRXL

SEQ ID NO: 678 - protein, 8 aa, Artificial Sequence
  Description of Artificial Sequence: Synthetic Peptide
  SITE (7)..(7): Xaa is C, D, F, H, L, M, P, S, or V
AKSELRXL

SEQ ID NO: 679 - protein, 8 aa, Artificial Sequence
  Description of Artificial Sequence: Synthetic Peptide
  SITE (7)..(7): Xaa is A, C, G, H, I, K, L, M, N, P, R, S, V, or Y
AKSEISXI

SEQ ID NO: 680 - protein, 8 aa, Artificial Sequence
  Description of Artificial Sequence: Synthetic Peptide
  SITE (7)..(7): Xaa is C, F, H, I, L,, M, V, or W
AKSELSXI

SEQ ID NO: 681 - protein, 8 aa, Artificial Sequence
  Description of Artificial Sequence: Synthetic Peptide
  SITE (7)..(7): Xaa is D, H, M, W, or Y
AKSEISXL

SEQ ID NO: 682 - protein, 8 aa, Artificial Sequence
  Description of Artificial Sequence: Synthetic Peptide
  SITE (7)..(7): Xaa is C, F, or W
AKSELSXL

SEQ ID NO: 683 - protein, 8 aa, Artificial Sequence
  Description of Artificial Sequence: Synthetic Peptide
  SITE (7)..(7): Xaa is C, F, G, H, L, M, N, P, V, W, or Y
AKSNIDXI

SEQ ID NO: 684 - protein, 8 aa, Artificial Sequence
  Description of Artificial Sequence: Synthetic Peptide
  SITE (7)..(7): Xaa is C, E, F, H, I, M, N, P, Q, S, T, V, W, or Y
AKSNLDXI

SEQ ID NO: 685 - protein, 8 aa, Artificial Sequence
  Description of Artificial Sequence: Synthetic Peptide
  SITE (7)..(7): Xaa is C, D, F, K, L, M, N, Q, V, or Y
AKSNIDXL

SEQ ID NO: 686 - protein, 8 aa, Artificial Sequence
  Description of Artificial Sequence: Synthetic Peptide
  SITE (7)..(7): Xaa is D, F, I, M, P, or Q
AKSNLDXL

SEQ ID NO: 687 - protein, 8 aa, Artificial Sequence
  Description of Artificial Sequence: Synthetic Peptide
  SITE (7)..(7): Xaa is D, E, F, G, H, L, M, P, Q, R, S, W, or Y
AKSNIRXI

SEQ ID NO: 688 - protein, 8 aa, Artificial Sequence
  Description of Artificial Sequence: Synthetic Peptide
  SITE (7)..(7): Xaa is A, C, D, F, G, I, M, P, Q, R, S, T, V, W, or Y
AKSNLRXI

SEQ ID NO: 689 - protein, 8 aa, Artificial Sequence
  Description of Artificial Sequence: Synthetic Peptide
  SITE (7)..(7): Xaa is D, E, F, G, H, L, M, P, Q, R, S, W, or Y
AKSNIRXI

SEQ ID NO: 690 - protein, 8 aa, Artificial Sequence
  Description of Artificial Sequence: Synthetic Peptide
  SITE (7)..(7): Xaa is A, C, D, F, G, I, M, P, Q, R, S, T, V, W, or Y
AKSNLRXI

SEQ ID NO: 691 - protein, 8 aa, Artificial Sequence
  Description of Artificial Sequence: Synthetic Peptide
  SITE (7)..(7): Xaa is C, D, E, G, H, I, M, N, P, R, T, V, W, or Y
AKSNIRXL

SEQ ID NO: 692 - protein, 8 aa, Artificial Sequence
  Description of Artificial Sequence: Synthetic Peptide
  SITE (7)..(7): Xaa is C, D, E ,F, G, H, M, R, S, T, or Y
AKSNLRXL

SEQ ID NO: 693 - protein, 8 aa, Artificial Sequence
  Description of Artificial Sequence: Synthetic Peptide
  SITE (7)..(7): Xaa is C, D, E, G, H, I, M, N, P, R, T, V, W, or Y
AKSNIRXL

SEQ ID NO: 694 - protein, 8 aa, Artificial Sequence
  Description of Artificial Sequence: Synthetic Peptide
  SITE (7)..(7): Xaa is A, C, E, F, G, I, K, M, N, P, Q, R, T, V, W, or Y
AKSNISXI

SEQ ID NO: 695 - protein, 8 aa, Artificial Sequence
  Description of Artificial Sequence: Synthetic Peptide
  SITE (7)..(7): Xaa is A, C, D, H, M, P, or Y
AKSNLSXI

SEQ ID NO: 696 - protein, 8 aa, Artificial Sequence
  Description of Artificial Sequence: Synthetic Peptide
  SITE (7)..(7): Xaa is C, F, G, H, K, L, M, P, Q, W, or Y
AKSNISXL

SEQ ID NO: 697 - protein, 8 aa, Artificial Sequence
  Description of Artificial Sequence: Synthetic Peptide
  SITE (7)..(7): Xaa is C, I, L, M, W, or Y
AKSNLSXL

SEQ ID NO: 698 - protein, 8 aa, Artificial Sequence
  Description of Artificial Sequence: Synthetic Peptide
  SITE (7)..(7): Xaa is C, H, I, K, M, P, R, V, or W
AKSQIDXI

SEQ ID NO: 699 - protein, 8 aa, Artificial Sequence
  Description of Artificial Sequence: Synthetic Peptide
  SITE (7)..(7): Xaa is A, C, D, H, I, K, M, N, Q, S, or W
AKSQLDXI

SEQ ID NO: 700 - protein, 8 aa, Artificial Sequence
  Description of Artificial Sequence: Synthetic Peptide
  SITE (7)..(7): Xaa is C, D, G, L, M, P, or T
AKSQIDXL

SEQ ID NO: 701 - protein, 8 aa, Artificial Sequence
  Description of Artificial Sequence: Synthetic Peptide
  SITE (7)..(7): Xaa is F, H, N, R, or W
AKSQLDXL

SEQ ID NO: 702 - protein, 8 aa, Artificial Sequence
  Description of Artificial Sequence: Synthetic Peptide
  SITE (7)..(7): Xaa is C, F, G, H, I, K, M, P, R, S, T, V, or Y
AKSQIRXI

SEQ ID NO: 703 - protein, 8 aa, Artificial Sequence
  Description of Artificial Sequence: Synthetic Peptide
  SITE (7)..(7): Xaa is C, E, F, H, I, L, M, P, Q, R, V, or Y
AKSQLRXI

SEQ ID NO: 704 - protein, 8 aa, Artificial Sequence
  Description of Artificial Sequence: Synthetic Peptide
  SITE (7)..(7): Xaa is A, C, D, E, F, G, K, L, M, P, Q, S, T, V, W, or Y
AKSQIRXL

SEQ ID NO: 705 - protein, 8 aa, Artificial Sequence
  Description of Artificial Sequence: Synthetic Peptide
  SITE (7)..(7): Xaa is C, D, F, G, H, I, M, N, P, T, V, W, or Y
AKSQLRXL

SEQ ID NO: 706 - protein, 8 aa, Artificial Sequence
  Description of Artificial Sequence: Synthetic Peptide
  SITE (7)..(7): Xaa is C, D, F, G, H, K, M, N, P, R, S, V, or Y
AKSQISXI

SEQ ID NO: 707 - protein, 8 aa, Artificial Sequence
  Description of Artificial Sequence: Synthetic Peptide
  SITE (7)..(7): Xaa is C, G, H, M, N, P, T, or W
AKSQLSXI

SEQ ID NO: 708 - protein, 8 aa, Artificial Sequence
  Description of Artificial Sequence: Synthetic Peptide
  SITE (7)..(7): Xaa is C, F, G, M, N, T, W, or Y
AKSQISXL

SEQ ID NO: 709 - protein, 8 aa, Artificial Sequence
  Description of Artificial Sequence: Synthetic Peptide
  SITE (7)..(7): Xaa is C, F, M, W, or Y
AKSQLSXL

SEQ ID NO: 710 - protein, 8 aa, Artificial Sequence
  Description of Artificial Sequence: Synthetic Peptide
  SITE (7)..(7): Xaa is C, G, H, K, L, M, N, P, W, or Y
AKSSIDXI

SEQ ID NO: 711 - protein, 8 aa, Artificial Sequence
  Description of Artificial Sequence: Synthetic Peptide
  SITE (7)..(7): Xaa is A, L, M, Q, V, or W
AKSSLDXI

SEQ ID NO: 712 - protein, 8 aa, Artificial Sequence
  Description of Artificial Sequence: Synthetic Peptide
  SITE (7)..(7): Xaa is I, P, Q, R, V, or W
AKSSIDXL

SEQ ID NO: 713 - protein, 8 aa, Artificial Sequence
  Description of Artificial Sequence: Synthetic Peptide
  SITE (7)..(7): Xaa is C, H, M, P, or V
AKSSLDXL

SEQ ID NO: 714 - protein, 8 aa, Artificial Sequence
  Description of Artificial Sequence: Synthetic Peptide
  SITE (7)..(7): Xaa is A, C, F, H, I, N, P, Q, R, T, V, or W
AKSSIRXI

SEQ ID NO: 715 - protein, 8 aa, Artificial Sequence
  Description of Artificial Sequence: Synthetic Peptide
  SITE (7)..(7): Xaa is C, F, G, H, I, M, N, P, Q, R, V, W, or Y
AKSSLRXI

SEQ ID NO: 716 - protein, 8 aa, Artificial Sequence
  Description of Artificial Sequence: Synthetic Peptide
  SITE (7)..(7): Xaa is C, E, F, G, I, M, P, Q, S, V, W, or Y
AKSSIRXL

SEQ ID NO: 717 - protein, 8 aa, Artificial Sequence
  Description of Artificial Sequence: Synthetic Peptide
  SITE (7)..(7): Xaa is D, F, G, N, P, or Y
AKSSLRXL

SEQ ID NO: 718 - protein, 8 aa, Artificial Sequence
  Description of Artificial Sequence: Synthetic Peptide
  SITE (7)..(7): Xaa is C, H, I, L, M, P, Q, T, or Y
AKSSISXI

SEQ ID NO: 719 - protein, 8 aa, Artificial Sequence
  Description of Artificial Sequence: Synthetic Peptide
  SITE (7)..(7): Xaa is E, H, M, P, R, S, V, or Y
AKSSLSXI

SEQ ID NO: 720 - protein, 8 aa, Artificial Sequence
  Description of Artificial Sequence: Synthetic Peptide
  SITE (7)..(7): Xaa is C, F, H, I, M, Q, or Y
AKSSISXL

SEQ ID NO: 721 - protein, 8 aa, Artificial Sequence
  Description of Artificial Sequence: Synthetic Peptide
  SITE (7)..(7): Xaa is F, M, P, W, or Y
AKSSLSXL

SEQ ID NO: 722 - protein, 8 aa, Artificial Sequence
  Description of Artificial Sequence: Synthetic Peptide
  SITE (7)..(7): Xaa is C, D, E, F, H, I, L, P, Q, S, V, W, or Y
FGADIDXI

SEQ ID NO: 723 - protein, 8 aa, Artificial Sequence
  Description of Artificial Sequence: Synthetic Peptide
  SITE (7)..(7): Xaa is C, D, F, G, H, K, L, M, N, P, S, T, W, Y
FGADLDXI

SEQ ID NO: 724 - protein, 8 aa, Artificial Sequence
  Description of Artificial Sequence: Synthetic Peptide
  SITE (7)..(7): Xaa is F, I, M, N, Q, V, or W
FGADIDXL

SEQ ID NO: 725 - protein, 8 aa, Artificial Sequence
  Description of Artificial Sequence: Synthetic Peptide
  SITE (7)..(7): Xaa is C, E, H, K, M, Q, E, or Y
FGADLDXL

SEQ ID NO: 726 - protein, 8 aa, Artificial Sequence
  Description of Artificial Sequence: Synthetic Peptide
  SITE (7)..(7): Xaa is C, D, E, F, G, H, L, N, Q, S, W, or Y
FGADIRXI

SEQ ID NO: 727 - protein, 8 aa, Artificial Sequence
  Description of Artificial Sequence: Synthetic Peptide
  SITE (7)..(7): Xaa is F, H, I, K, M, P, Q, T, V, W, or Y
FGADLRXI

SEQ ID NO: 728 - protein, 8 aa, Artificial Sequence
  Description of Artificial Sequence: Synthetic Peptide
  SITE (7)..(7): Xaa is C, E, L, N, P, Q, R, S, W, or Y
FGADIRXL

SEQ ID NO: 729 - protein, 8 aa, Artificial Sequence
  Description of Artificial Sequence: Synthetic Peptide
  SITE (7)..(7): Xaa is C, I, K, N, or P
FGADLRXL

SEQ ID NO: 730 - protein, 8 aa, Artificial Sequence
  Description of Artificial Sequence: Synthetic Peptide
  SITE (7)..(7): Xaa is C, E, M, P, Q, or R
FGADISXI

SEQ ID NO: 731 - protein, 8 aa, Artificial Sequence
  Description of Artificial Sequence: Synthetic Peptide
  SITE (7)..(7): Xaa is A, C, E, Q, R. V. or W
FGADLSXI

SEQ ID NO: 732 - protein, 8 aa, Artificial Sequence
  Description of Artificial Sequence: Synthetic Peptide
  SITE (7)..(7): Xaa is C, D, F, H, M, P, Q, W, or Y
FGADISXL

SEQ ID NO: 733 - protein, 8 aa, Artificial Sequence
  Description of Artificial Sequence: Synthetic Peptide
  SITE (7)..(7): Xaa is C, F, K, L, M, S, T, or W
FGADLSXL

SEQ ID NO: 734 - protein, 8 aa, Artificial Sequence
  Description of Artificial Sequence: Synthetic Peptide
  SITE (7)..(7): Xaa is C, H, L, , W, or Y
FGAELDXI

SEQ ID NO: 735 - protein, 8 aa, Artificial Sequence
  Description of Artificial Sequence: Synthetic Peptide
  SITE (7)..(7): Xaa is E, H, K, L. M. P, Q, W, or Y
FGAEIDXL

SEQ ID NO: 736 - protein, 8 aa, Artificial Sequence
  Description of Artificial Sequence: Synthetic Peptide
  SITE (7)..(7): Xaa is H, K, L, M, P, Q, W, or Y
FGAEIDXL

SEQ ID NO: 737 - protein, 8 aa, Artificial Sequence
  Description of Artificial Sequence: Synthetic Peptide
  SITE (7)..(7): Xaa is C, D, F, H, M ,N ,or Y
FGAELDXL

SEQ ID NO: 738 - protein, 8 aa, Artificial Sequence
  Description of Artificial Sequence: Synthetic Peptide
  SITE (7)..(7): Xaa is C, D, E, F, H, K, M, N, P, Q, R, T, W, or Y
FGAEIRXI

SEQ ID NO: 739 - protein, 8 aa, Artificial Sequence
  Description of Artificial Sequence: Synthetic Peptide
  SITE (7)..(7): Xaa is C, D, E, H, I, K, L, M, N, P, Q, S, T, or W
FGAELRXI

SEQ ID NO: 740 - protein, 8 aa, Artificial Sequence
  Description of Artificial Sequence: Synthetic Peptide
  SITE (7)..(7): Xaa is C, H, K, M, P, S, T, V, W, or Y
FGAEIRXL

SEQ ID NO: 741 - protein, 8 aa, Artificial Sequence
  Description of Artificial Sequence: Synthetic Peptide
  SITE (7)..(7): Xaa is C, W, or Y
FGAELRXL

SEQ ID NO: 742 - protein, 8 aa, Artificial Sequence
  Description of Artificial Sequence: Synthetic Peptide
  SITE (7)..(7): Xaa is C, I, N, P, R, or Y
FGAEISXI

SEQ ID NO: 743 - protein, 8 aa, Artificial Sequence
  Description of Artificial Sequence: Synthetic Peptide
  SITE (7)..(7): Xaa is C, F, I, M, N, or W
FGAELSXI

SEQ ID NO: 744 - protein, 8 aa, Artificial Sequence
  Description of Artificial Sequence: Synthetic Peptide
  SITE (7)..(7): Xaa is C, D, H, M, P, R, V, or Y
FGAEISXL

SEQ ID NO: 745 - protein, 8 aa, Artificial Sequence
  Description of Artificial Sequence: Synthetic Peptide
  SITE (7)..(7): Xaa is D, F, I, M, N, Q, V, W, or Y
FGAELSXL

SEQ ID NO: 746 - protein, 8 aa, Artificial Sequence
  Description of Artificial Sequence: Synthetic Peptide
  SITE (7)..(7): Xaa is C, E, F, H, I, K, L, M, P, Q, S, T, V, W, or Y
FGANIDXI

SEQ ID NO: 747 - protein, 8 aa, Artificial Sequence
  Description of Artificial Sequence: Synthetic Peptide
  SITE (7)..(7): Xaa is A, C, F, G, H, N, P, Q, R, S, T, V, W, or Y
FGANLDXI

SEQ ID NO: 748 - protein, 8 aa, Artificial Sequence
  Description of Artificial Sequence: Synthetic Peptide
  SITE (7)..(7): Xaa is A, C, D, E, F, G, I, K, M, N, Q, S, T, or W
FGANIDXL

SEQ ID NO: 749 - protein, 8 aa, Artificial Sequence
  Description of Artificial Sequence: Synthetic Peptide
  SITE (7)..(7): Xaa is C, D, F, G, H, K, N, M, P, R, W, or Y
FGANLDXL

SEQ ID NO: 750 - protein, 8 aa, Artificial Sequence
  Description of Artificial Sequence: Synthetic Peptide
  SITE (7)..(7): Xaa is C, D, E, F, G ,H, K, M, P, Q, R, S, T, W, or Y
FGANIRXI

SEQ ID NO: 751 - protein, 8 aa, Artificial Sequence
  Description of Artificial Sequence: Synthetic Peptide
  SITE (7)..(7): Xaa is C, D, F, G, I, M, W, or Y
FGANLRXI

SEQ ID NO: 752 - protein, 8 aa, Artificial Sequence
  Description of Artificial Sequence: Synthetic Peptide
  SITE (7)..(7): Xaa is C, D, E, F, G, H, I, K, M, N, P, Q, R, S, T, V, W, or Y
FGANIRXL

SEQ ID NO: 753 - protein, 8 aa, Artificial Sequence
  Description of Artificial Sequence: Synthetic Peptide
  SITE (7)..(7): Xaa is C, F, G, M, P, W, or Y
FGANLRXL

SEQ ID NO: 754 - protein, 8 aa, Artificial Sequence
  Description of Artificial Sequence: Synthetic Peptide
  SITE (7)..(7): Xaa is A, C, D, E, G, H, K, L, M, P, R, W, or Y
FGANISXI

SEQ ID NO: 755 - protein, 8 aa, Artificial Sequence
  Description of Artificial Sequence: Synthetic Peptide
  SITE (7)..(7): Xaa is C, H, K, M, Q, R, S, T, or W
FGANLSXI

SEQ ID NO: 756 - protein, 8 aa, Artificial Sequence
  Description of Artificial Sequence: Synthetic Peptide
  SITE (7)..(7): Xaa is C, E, F, G, H, I, L, M, Q, S, V, or W
FGANISXL

SEQ ID NO: 757 - protein, 8 aa, Artificial Sequence
  Description of Artificial Sequence: Synthetic Peptide
  SITE (7)..(7): Xaa is C, E, F, I, K, L. M. Q. or W
FGANLSXL

SEQ ID NO: 758 - protein, 8 aa, Artificial Sequence
  Description of Artificial Sequence: Synthetic Peptide
  SITE (7)..(7): Xaa is C, D, E, F, I, K, L, M, N, P, Q, R, S, T, W, or Y
FGAQIDXI

SEQ ID NO: 759 - protein, 8 aa, Artificial Sequence
  Description of Artificial Sequence: Synthetic Peptide
  SITE (7)..(7): Xaa is C, E, F, H, I, K, L, M, N, P, Q, R, S, T, V, W, or Y
FGAQLDXI

SEQ ID NO: 760 - protein, 8 aa, Artificial Sequence
  Description of Artificial Sequence: Synthetic Peptide
  SITE (7)..(7): Xaa is C, D, F, G, L, M, N, R, S, V, W
FGAQIDXL

SEQ ID NO: 761 - protein, 8 aa, Artificial Sequence
  Description of Artificial Sequence: Synthetic Peptide
  SITE (7)..(7): Xaa is A, D, F, I, N, P, T, V, W, or Y
FGAQLDXL

SEQ ID NO: 762 - protein, 8 aa, Artificial Sequence
  Description of Artificial Sequence: Synthetic Peptide
  SITE (7)..(7): Xaa is C, D, E, F, G, H, K, L, M, N, P, Q, R, S, T, V, W, or Y
FGAQIRXI

SEQ ID NO: 763 - protein, 8 aa, Artificial Sequence
  Description of Artificial Sequence: Synthetic Peptide
  SITE (7)..(7): Xaa is C, D, E, F, G, H, I, K, M, N, P, Q, S, T, V, W, or Y
FGAQLRXI

SEQ ID NO: 764 - protein, 8 aa, Artificial Sequence
  Description of Artificial Sequence: Synthetic Peptide
  SITE (7)..(7): Xaa is A, C, F, G, H, K, M, N, P, Q, R, S, T, W, or Y
FGAQIRXL

SEQ ID NO: 765 - protein, 8 aa, Artificial Sequence
  Description of Artificial Sequence: Synthetic Peptide
  SITE (7)..(7): Xaa is A, C, G, H, M, N, V, W, or Y
FGAQLRXL

SEQ ID NO: 766 - protein, 8 aa, Artificial Sequence
  Description of Artificial Sequence: Synthetic Peptide
  SITE (7)..(7): Xaa is A, C, D, E, F, H, I, M, N, R, S, T, V, W, or Y
FGAQISXI

SEQ ID NO: 767 - protein, 8 aa, Artificial Sequence
  Description of Artificial Sequence: Synthetic Peptide
  SITE (7)..(7): Xaa is C, E, H, L, M, N, P, R, T, V, W, or Y
FGAQLSXI

SEQ ID NO: 768 - protein, 8 aa, Artificial Sequence
  Description of Artificial Sequence: Synthetic Peptide
  SITE (7)..(7): Xaa is C, D, F, I, M, N, Q, R, S, or Y
FGAQISXL

SEQ ID NO: 769 - protein, 8 aa, Artificial Sequence
  Description of Artificial Sequence: Synthetic Peptide
  SITE (7)..(7): Xaa is A, C, F, G, H, K, M, P, R, W, or Y
FGAQLSXL

SEQ ID NO: 770 - protein, 8 aa, Artificial Sequence
  Description of Artificial Sequence: Synthetic Peptide
  SITE (7)..(7): Xaa is A, C, D, E, G, I, K, L, M, P, R, S, W, or Y
FGASIDXI

SEQ ID NO: 771 - protein, 8 aa, Artificial Sequence
  Description of Artificial Sequence: Synthetic Peptide
  SITE (7)..(7): Xaa is C, F, H, I, M, N, Q, S, T, or W
FGASLDXI

SEQ ID NO: 772 - protein, 8 aa, Artificial Sequence
  Description of Artificial Sequence: Synthetic Peptide
  SITE (7)..(7): Xaa is A, C, F, H, I, K, L, P, V, W, or Y
FGASIDXL

SEQ ID NO: 773 - protein, 8 aa, Artificial Sequence
  Description of Artificial Sequence: Synthetic Peptide
  SITE (7)..(7): Xaa is D, F, I, M, P, Q, V, W, or Y
FGASLDXL

SEQ ID NO: 774 - protein, 8 aa, Artificial Sequence
  Description of Artificial Sequence: Synthetic Peptide
  SITE (7)..(7): Xaa is C, E, F, G, H, K, M, P, Q, V, W, or Y
FGASIRXI

SEQ ID NO: 775 - protein, 8 aa, Artificial Sequence
  Description of Artificial Sequence: Synthetic Peptide
  SITE (7)..(7): Xaa is C, D, E, I, M, N, R, S, or W
FGASLRXI

SEQ ID NO: 776 - protein, 8 aa, Artificial Sequence
  Description of Artificial Sequence: Synthetic Peptide
  SITE (7)..(7): Xaa is C, F, G, H, L, M, N, P, T, V, or W
FGASIRXL

SEQ ID NO: 777 - protein, 8 aa, Artificial Sequence
  Description of Artificial Sequence: Synthetic Peptide
  SITE (7)..(7): Xaa is A, F, H, I, M, or W
FGASLRXL

SEQ ID NO: 778 - protein, 8 aa, Artificial Sequence
  Description of Artificial Sequence: Synthetic Peptide
  SITE (7)..(7): Xaa is C, E, H, K, N, P, V, or Y
FGASISXI

SEQ ID NO: 779 - protein, 8 aa, Artificial Sequence
  Description of Artificial Sequence: Synthetic Peptide
  SITE (7)..(7): Xaa is C, G, H, P, R, W, or Y
FGASLSXI

SEQ ID NO: 780 - protein, 8 aa, Artificial Sequence
  Description of Artificial Sequence: Synthetic Peptide
  SITE (7)..(7): Xaa is C, E, I, M, R, V, W, or Y
FGASISXL

SEQ ID NO: 781 - protein, 8 aa, Artificial Sequence
  Description of Artificial Sequence: Synthetic Peptide
  SITE (7)..(7): Xaa is A, C, or N
FGASLSXL

SEQ ID NO: 782 - protein, 8 aa, Artificial Sequence
  Description of Artificial Sequence: Synthetic Peptide
  SITE (7)..(7): Xaa is A, C, D, E, F, H, I, K, L, M, P, R, S, W, or Y
FGGDIDXI

SEQ ID NO: 783 - protein, 8 aa, Artificial Sequence
  Description of Artificial Sequence: Synthetic Peptide
  SITE (7)..(7): Xaa is A, C, D, E, F, H, I, N, P, S, T, V, W, or Y
FGGDLDXI

SEQ ID NO: 784 - protein, 8 aa, Artificial Sequence
  Description of Artificial Sequence: Synthetic Peptide
  SITE (7)..(7): Xaa is C, D, E, F, H, M, N, P, Q, T, or Y
FGGDIDXL

SEQ ID NO: 785 - protein, 8 aa, Artificial Sequence
  Description of Artificial Sequence: Synthetic Peptide
  SITE (7)..(7): Xaa is A, C, F, I, L, N, Q, S, W, or Y
FGGDLDXL

SEQ ID NO: 786 - protein, 8 aa, Artificial Sequence
  Description of Artificial Sequence: Synthetic Peptide
  SITE (7)..(7): Xaa is A, C, D, H, K, L, M, N, P, Q, R, S, W, or Y
FGGDIRXI

SEQ ID NO: 787 - protein, 8 aa, Artificial Sequence
  Description of Artificial Sequence: Synthetic Peptide
  SITE (7)..(7): Xaa is C, D, E, I, M, P, S, V, W, or Y
FGGDLRXI

SEQ ID NO: 788 - protein, 8 aa, Artificial Sequence
  Description of Artificial Sequence: Synthetic Peptide
  SITE (7)..(7): Xaa is C, D, E, H, L, M, R, S, W, or Y
FGGDIRXL

SEQ ID NO: 789 - protein, 8 aa, Artificial Sequence
  Description of Artificial Sequence: Synthetic Peptide
  SITE (7)..(7): Xaa is C, D, F, P, Q, T, W, or Y
FGGDLRXL

SEQ ID NO: 790 - protein, 8 aa, Artificial Sequence
  Description of Artificial Sequence: Synthetic Peptide
  SITE (7)..(7): Xaa is C, H, I, M, P, Q, or Y
FGGDISXI

SEQ ID NO: 791 - protein, 8 aa, Artificial Sequence
  Description of Artificial Sequence: Synthetic Peptide
  SITE (7)..(7): Xaa is A, E, F, H, M, N, W, or Y
FGGDLSXI

SEQ ID NO: 792 - protein, 8 aa, Artificial Sequence
  Description of Artificial Sequence: Synthetic Peptide
  SITE (7)..(7): Xaa is D, F, I, L, M, P, Q, R, W, or Y
FGGDISXL

SEQ ID NO: 793 - protein, 8 aa, Artificial Sequence
  Description of Artificial Sequence: Synthetic Peptide
  SITE (7)..(7): Xaa is C, F, H, K, L, M, Q, W, or Y
FGGDLSXL

SEQ ID NO: 794 - protein, 8 aa, Artificial Sequence
  Description of Artificial Sequence: Synthetic Peptide
  SITE (7)..(7): Xaa is A, C, D, E, G, H, K, L, M, N, P, R, S, V, or Y
FGGEIDXI

SEQ ID NO: 795 - protein, 8 aa, Artificial Sequence
  Description of Artificial Sequence: Synthetic Peptide
  SITE (7)..(7): Xaa is C, D, E, G, I, K, L, M, N, P, Q, S, T, V, W, or Y
FGGELDXI

SEQ ID NO: 796 - protein, 8 aa, Artificial Sequence
  Description of Artificial Sequence: Synthetic Peptide
  SITE (7)..(7): Xaa is C, D, E, F, H, N, or Y
FGGEIDXL

SEQ ID NO: 797 - protein, 8 aa, Artificial Sequence
  Description of Artificial Sequence: Synthetic Peptide
  SITE (7)..(7): Xaa is C, E, F, H, M, or W
FGGELDXL

SEQ ID NO: 798 - protein, 8 aa, Artificial Sequence
  Description of Artificial Sequence: Synthetic Peptide
  SITE (7)..(7): Xaa is A, E, F, G, H, I, K, L, M, N, P, R, S, T, or Y
FGGEIRXI

SEQ ID NO: 799 - protein, 8 aa, Artificial Sequence
  Description of Artificial Sequence: Synthetic Peptide
  SITE (7)..(7): Xaa is C, D, E, G, H, I, N, Q, R, S, W, or Y
FGGELRXI

SEQ ID NO: 800 - protein, 8 aa, Artificial Sequence
  Description of Artificial Sequence: Synthetic Peptide
  SITE (7)..(7): Xaa is C, E, F, G, H, K, L, N, P, S, T, V, W, or Y
FGGEIRXL

SEQ ID NO: 801 - protein, 8 aa, Artificial Sequence
  Description of Artificial Sequence: Synthetic Peptide
  SITE (7)..(7): Xaa is A, E, H, I, K, P, S, T, or V
FGGELRXL

SEQ ID NO: 802 - protein, 8 aa, Artificial Sequence
  Description of Artificial Sequence: Synthetic Peptide
  SITE (7)..(7): Xaa is C, E, F, H, I, K, M, N, Q, S, T, V, and W
FGGEISXI

SEQ ID NO: 803 - protein, 8 aa, Artificial Sequence
  Description of Artificial Sequence: Synthetic Peptide
  SITE (7)..(7): Xaa is A, C, F, H, I, K, L, M, P, Q, and W
FGGELSXI

SEQ ID NO: 804 - protein, 8 aa, Artificial Sequence
  Description of Artificial Sequence: Synthetic Peptide
  SITE (7)..(7): Xaa is A, C, E, I, M, N, Q, R, T, and V
FGGEISXL

SEQ ID NO: 805 - protein, 8 aa, Artificial Sequence
  Description of Artificial Sequence: Synthetic Peptide
  SITE (7)..(7): Xaa is C, F, G, H, I, K, Q, R, T, V, and Y
FGGELSXL

SEQ ID NO: 806 - protein, 8 aa, Artificial Sequence
  Description of Artificial Sequence: Synthetic Peptide
  SITE (7)..(7): Xaa is A, C, D, E, G, H, I, K, M, P, Q, R, S, T, V, W, or Y
FGGNIDXI

SEQ ID NO: 807 - protein, 8 aa, Artificial Sequence
  Description of Artificial Sequence: Synthetic Peptide
  SITE (7)..(7): Xaa is C, D, E, F, H, I, K, L, M, N, P, Q, R, S, T, V, W, or Y
FGGNLDXI

SEQ ID NO: 808 - protein, 8 aa, Artificial Sequence
  Description of Artificial Sequence: Synthetic Peptide
  SITE (7)..(7): Xaa is C, D, F, G, H, I, M, N, P, Q, R, T, V, W, or Y
FGGNIDXL

SEQ ID NO: 809 - protein, 8 aa, Artificial Sequence
  Description of Artificial Sequence: Synthetic Peptide
  SITE (7)..(7): Xaa is C, F, H, K, L, M, N, P, Q, R, or W
FGGNLDXL

SEQ ID NO: 810 - protein, 8 aa, Artificial Sequence
  Description of Artificial Sequence: Synthetic Peptide
  SITE (7)..(7): Xaa is A, C, D, F, H, I, K, L, N, P, Q, R, V, W, or Y
FGGNIRXI

SEQ ID NO: 811 - protein, 8 aa, Artificial Sequence
  Description of Artificial Sequence: Synthetic Peptide
  SITE (7)..(7): Xaa is A, C, H, M, P, R, S, T, W, or Y
FGGNLRXI

SEQ ID NO: 812 - protein, 8 aa, Artificial Sequence
  Description of Artificial Sequence: Synthetic Peptide
  SITE (7)..(7): Xaa is A, C, D, E, K, L, M, N, P, Q, S, T, V, or W
FGGNIRXL

SEQ ID NO: 813 - protein, 8 aa, Artificial Sequence
  Description of Artificial Sequence: Synthetic Peptide
  SITE (7)..(7): Xaa is A, C, D, F, I, K, M, N, R, T, W, or Y
FGGNLRXL

SEQ ID NO: 814 - protein, 8 aa, Artificial Sequence
  Description of Artificial Sequence: Synthetic Peptide
  SITE (7)..(7): Xaa is F, G, H, K, L, M, N, P, Q, R, S, W, or Y
FGGNISXI

SEQ ID NO: 815 - protein, 8 aa, Artificial Sequence
  Description of Artificial Sequence: Synthetic Peptide
  SITE (7)..(7): Xaa is A, C, F, M, N, R, S, T, W, or Y
FGGNLSXI

SEQ ID NO: 816 - protein, 8 aa, Artificial Sequence
  Description of Artificial Sequence: Synthetic Peptide
  SITE (7)..(7): Xaa is A, C, D, F, H, I, K, M, P, Q, W, or Y
FGGNISXL

SEQ ID NO: 817 - protein, 8 aa, Artificial Sequence
  Description of Artificial Sequence: Synthetic Peptide
  SITE (7)..(7): Xaa is A, C, D, F, N, or W
FGGNLSXL

SEQ ID NO: 818 - protein, 8 aa, Artificial Sequence
  Description of Artificial Sequence: Synthetic Peptide
  SITE (7)..(7): Xaa is C, D, E, H, I, K, L, M, N, P, Q, R, S, T, V, W, or Y
FGGQIDXI

SEQ ID NO: 819 - protein, 8 aa, Artificial Sequence
  Description of Artificial Sequence: Synthetic Peptide
  SITE (7)..(7): Xaa is A, C, D, G, H, I, K, L, M, N, P, Q, W, or Y
FGGQLDXI

SEQ ID NO: 820 - protein, 8 aa, Artificial Sequence
  Description of Artificial Sequence: Synthetic Peptide
  SITE (7)..(7): Xaa is A, C, D, E, G, K, P, Q, R, or W
FGGQIDXL

SEQ ID NO: 821 - protein, 8 aa, Artificial Sequence
  Description of Artificial Sequence: Synthetic Peptide
  SITE (7)..(7): Xaa is C, E, H, M, N, P, T, W, or Y
FGGQLDXL

SEQ ID NO: 822 - protein, 8 aa, Artificial Sequence
  Description of Artificial Sequence: Synthetic Peptide
  SITE (7)..(7): Xaa is A, C, D, E, F, G, H, I, L, M, N, P, Q, R, S, T, V, W, or Y
FGGQIRXI

SEQ ID NO: 823 - protein, 8 aa, Artificial Sequence
  Description of Artificial Sequence: Synthetic Peptide
  SITE (7)..(7): Xaa is C, D, H, I, K, M, N, P, Q, R, S, T, V, W, or Y
FGGQLRXI

SEQ ID NO: 824 - protein, 8 aa, Artificial Sequence
  Description of Artificial Sequence: Synthetic Peptide
  SITE (7)..(7): Xaa is A, C, G, H, I, K, M, N, P, S, T, V, W, or Y
FGGQIRXL

SEQ ID NO: 825 - protein, 8 aa, Artificial Sequence
  Description of Artificial Sequence: Synthetic Peptide
  SITE (7)..(7): Xaa is A, C, F, H, I, K, L, M, N, P, Q, R, T, W, or Y
FGGQLRXL

SEQ ID NO: 826 - protein, 8 aa, Artificial Sequence
  Description of Artificial Sequence: Synthetic Peptide
  SITE (7)..(7): Xaa is A, C, D, E, G, H, I, K, L, M, N, R, S, T, V, W, or Y
FGGQISXI

SEQ ID NO: 827 - protein, 8 aa, Artificial Sequence
  Description of Artificial Sequence: Synthetic Peptide
  SITE (7)..(7): Xaa is A, C, D, E, F, H, I, L, P, Q, R, S, T, V, W, or Y
FGGQLSXI

SEQ ID NO: 828 - protein, 8 aa, Artificial Sequence
  Description of Artificial Sequence: Synthetic Peptide
  SITE (7)..(7): Xaa is A, C, E, H, I, K, M, N, R, T, or V
FGGQISXL

SEQ ID NO: 829 - protein, 8 aa, Artificial Sequence
  Description of Artificial Sequence: Synthetic Peptide
  SITE (7)..(7): Xaa is C, G, H, I, N, Q, R, V, or W
FGGQLSXL

SEQ ID NO: 830 - protein, 8 aa, Artificial Sequence
  Description of Artificial Sequence: Synthetic Peptide
  SITE (7)..(7): Xaa is A, C, G, H, I, K, L, M, Q, T, or W
FGGSIDXI

SEQ ID NO: 831 - protein, 8 aa, Artificial Sequence
  Description of Artificial Sequence: Synthetic Peptide
  SITE (7)..(7): Xaa is C, D, E, F, H, I, K, M, Q, T, or W
FGGSLDXI

SEQ ID NO: 832 - protein, 8 aa, Artificial Sequence
  Description of Artificial Sequence: Synthetic Peptide
  SITE (7)..(7): Xaa is C, E, F, G, K, R, or W
FGGSIDXL

SEQ ID NO: 833 - protein, 8 aa, Artificial Sequence
  Description of Artificial Sequence: Synthetic Peptide
  SITE (7)..(7): Xaa is F, H, K, R, T, or W
FGGSLDXL

SEQ ID NO: 834 - protein, 8 aa, Artificial Sequence
  Description of Artificial Sequence: Synthetic Peptide
  SITE (7)..(7): Xaa is A, C, D, F, H, I, K, M, P, R, T, W, or Y
FGGSIRXI

SEQ ID NO: 835 - protein, 8 aa, Artificial Sequence
  Description of Artificial Sequence: Synthetic Peptide
  SITE (7)..(7): Xaa is C, F, H, K, L, M, R, T, or W
FGGSLRXI

SEQ ID NO: 836 - protein, 8 aa, Artificial Sequence
  Description of Artificial Sequence: Synthetic Peptide
  SITE (7)..(7): Xaa is C, D, E, I, L, M, P, Q, R, T, V, W, or Y
FGGSIRXL

SEQ ID NO: 837 - protein, 8 aa, Artificial Sequence
  Description of Artificial Sequence: Synthetic Peptide
  SITE (7)..(7): Xaa is C, F, or W
FGGSLRXL

SEQ ID NO: 838 - protein, 8 aa, Artificial Sequence
  Description of Artificial Sequence: Synthetic Peptide
  SITE (7)..(7): Xaa is A, C, G, H, I, K, L, M, Q, T, W, or Y
FGGSISXI

SEQ ID NO: 839 - protein, 8 aa, Artificial Sequence
  Description of Artificial Sequence: Synthetic Peptide
  SITE (7)..(7): Xaa is H, N, Q, W, or Y
FGGSLSXI

SEQ ID NO: 840 - protein, 8 aa, Artificial Sequence
  Description of Artificial Sequence: Synthetic Peptide
  SITE (7)..(7): Xaa is C, D, E, I, L, M, P, Q, R, T, V, W, or Y
FGGSISXL

SEQ ID NO: 841 - protein, 8 aa, Artificial Sequence
  Description of Artificial Sequence: Synthetic Peptide
  SITE (7)..(7): Xaa is C, F, H, I, or Y
FGGSLSXL

SEQ ID NO: 842 - protein, 8 aa, Artificial Sequence
  Description of Artificial Sequence: Synthetic Peptide
  SITE (7)..(7): Xaa is A, F, H, P, Q, R, W, or Y
FGLDIDXI

SEQ ID NO: 843 - protein, 8 aa, Artificial Sequence
  Description of Artificial Sequence: Synthetic Peptide
  SITE (7)..(7): Xaa is C, D, H, L, N, S, or Y
FGLDLDXI

SEQ ID NO: 844 - protein, 8 aa, Artificial Sequence
  Description of Artificial Sequence: Synthetic Peptide
  SITE (7)..(7): Xaa is A, C, F, H, K, M, N, S, T, V, or Y
FGLDIDXL

SEQ ID NO: 845 - protein, 8 aa, Artificial Sequence
  Description of Artificial Sequence: Synthetic Peptide
  SITE (7)..(7): Xaa is C, F, I, K, M, N, W, or Y
FGLDLDXL

SEQ ID NO: 846 - protein, 8 aa, Artificial Sequence
  Description of Artificial Sequence: Synthetic Peptide
  SITE (7)..(7): Xaa is C, E, H, M, P, Q, R, S, T, V, W, or Y
FGLDIRXI

SEQ ID NO: 847 - protein, 8 aa, Artificial Sequence
  Description of Artificial Sequence: Synthetic Peptide
  SITE (7)..(7): Xaa is A, C, E, I, L, M, P, Q, R, S ,T ,V, W, or Y
FGLDLRXI

SEQ ID NO: 848 - protein, 8 aa, Artificial Sequence
  Description of Artificial Sequence: Synthetic Peptide
  SITE (7)..(7): Xaa is C, D, E, F, K, M, N, P, Q, R, V, or Y
FGLDIRXL

SEQ ID NO: 849 - protein, 8 aa, Artificial Sequence
  Description of Artificial Sequence: Synthetic Peptide
  SITE (7)..(7): Xaa is C, G, K, P, Q, R, W, or Y
FGLDLRXL

SEQ ID NO: 850 - protein, 8 aa, Artificial Sequence
  Description of Artificial Sequence: Synthetic Peptide
  SITE (7)..(7): Xaa is H, T, or W
FGLDLSXI

SEQ ID NO: 851 - protein, 8 aa, Artificial Sequence
  Description of Artificial Sequence: Synthetic Peptide
  SITE (7)..(7): Xaa is E, G, M, N, P, Q, W, or Y
FGLDISXL

SEQ ID NO: 852 - protein, 8 aa, Artificial Sequence
  Description of Artificial Sequence: Synthetic Peptide
  SITE (7)..(7): Xaa is E, M, Q, or W
FGLDLSXL

SEQ ID NO: 853 - protein, 8 aa, Artificial Sequence
  Description of Artificial Sequence: Synthetic Peptide
  SITE (7)..(7): Xaa is A, C, F, G, I, L, M, P, Q, R, T, W, or Y
FGLEIDXI

SEQ ID NO: 854 - protein, 8 aa, Artificial Sequence
  Description of Artificial Sequence: Synthetic Peptide
  SITE (7)..(7): Xaa is F, H, I, M, N, P, or W
FGLELDXI

SEQ ID NO: 855 - protein, 8 aa, Artificial Sequence
  Description of Artificial Sequence: Synthetic Peptide
  SITE (7)..(7): Xaa is C, D, F, H, I, M, P, Q, W, or Y
FGLEIDXL

SEQ ID NO: 856 - protein, 8 aa, Artificial Sequence
  Description of Artificial Sequence: Synthetic Peptide
  SITE (7)..(7): Xaa is C, H, I, K, N, T, V ,W, or Y
FGLELDXL

SEQ ID NO: 857 - protein, 8 aa, Artificial Sequence
  Description of Artificial Sequence: Synthetic Peptide
  SITE (7)..(7): Xaa is A, C, D, E, F, H, I, M, P, Q, R, T, V, W, or Y
FGLEIRXI

SEQ ID NO: 858 - protein, 8 aa, Artificial Sequence
  Description of Artificial Sequence: Synthetic Peptide
  SITE (7)..(7): Xaa ia A, C, E, F, I, K, Q, S, T, V, W, or Y
FGLELRXI

SEQ ID NO: 859 - protein, 8 aa, Artificial Sequence
  Description of Artificial Sequence: Synthetic Peptide
  SITE (7)..(7): Xaa is A, C, D, F, H, M, Q, T, W, or Y
FGLEIRXL

SEQ ID NO: 860 - protein, 8 aa, Artificial Sequence
  Description of Artificial Sequence: Synthetic Peptide
  SITE (7)..(7): Xaa is C, F, H, M, P, R, T, V, or Y
FGLELRXL

SEQ ID NO: 861 - protein, 8 aa, Artificial Sequence
  Description of Artificial Sequence: Synthetic Peptide
  SITE (7)..(7): Xaa is A, C, D, H, I, N, T, or W
FGLEISXI

SEQ ID NO: 862 - protein, 8 aa, Artificial Sequence
  Description of Artificial Sequence: Synthetic Peptide
  SITE (7)..(7): Xaa is H, K, L, M, N, T, or Y
FGLELSXI

SEQ ID NO: 863 - protein, 8 aa, Artificial Sequence
  Description of Artificial Sequence: Synthetic Peptide
  SITE (7)..(7): Xaa is C, D, F, H, I, P, or Q
FGLEISXL

SEQ ID NO: 864 - protein, 8 aa, Artificial Sequence
  Description of Artificial Sequence: Synthetic Peptide
  SITE (7)..(7): Xaa is C, S, T, W, or Y
FGLELSXL

SEQ ID NO: 865 - protein, 8 aa, Artificial Sequence
  Description of Artificial Sequence: Synthetic Peptide
  SITE (7)..(7): Xaa is C, G, I, L, P, Q, V, W, or Y
FGLNIDXI

SEQ ID NO: 866 - protein, 8 aa, Artificial Sequence
  Description of Artificial Sequence: Synthetic Peptide
  SITE (7)..(7): Xaa is C, E, F, G, H, K, L, N, P, Q, R, T, or Y
FGLNLDXI

SEQ ID NO: 867 - protein, 8 aa, Artificial Sequence
  Description of Artificial Sequence: Synthetic Peptide
  SITE (7)..(7): Xaa is C, D, F, G, H, M, P, Q, T, V, or Y
FGLNIDXL

SEQ ID NO: 868 - protein, 8 aa, Artificial Sequence
  Description of Artificial Sequence: Synthetic Peptide
  SITE (7)..(7): Xaa is C, D, F, H, K, M, Q, S, V, or W
FGLNLDXL

SEQ ID NO: 869 - protein, 8 aa, Artificial Sequence
  Description of Artificial Sequence: Synthetic Peptide
  SITE (7)..(7): Xaa is A, C, D, E, F, G, H, I, L, M, N, P, Q, R, T, V, W, or Y
FGLNIRXI

SEQ ID NO: 870 - protein, 8 aa, Artificial Sequence
  Description of Artificial Sequence: Synthetic Peptide
  SITE (7)..(7): Xaa is A, D, G, H, I, K, L, M, N, P, R, S, T, W, or Y
FGLNLRXI

SEQ ID NO: 871 - protein, 8 aa, Artificial Sequence
  Description of Artificial Sequence: Synthetic Peptide
  SITE (7)..(7): Xaa is A, C, D, E, F, G, H, I, K, L, M, N, Q, R, V, W, or Y
FGLNIRXL

SEQ ID NO: 872 - protein, 8 aa, Artificial Sequence
  Description of Artificial Sequence: Synthetic Peptide
  SITE (7)..(7): Xaa is A, C, I, L, M, S, T, or Y
FGLNLRXL

SEQ ID NO: 873 - protein, 8 aa, Artificial Sequence
  Description of Artificial Sequence: Synthetic Peptide
  SITE (7)..(7): Xaa is A, C, G, H, I, L, M, V, W, or Y
FGLNISXI

SEQ ID NO: 874 - protein, 8 aa, Artificial Sequence
  Description of Artificial Sequence: Synthetic Peptide
  SITE (7)..(7): Xaa is C, D, H, L, P, T, or Y
FGLNLSXI

SEQ ID NO: 875 - protein, 8 aa, Artificial Sequence
  Description of Artificial Sequence: Synthetic Peptide
  SITE (7)..(7): Xaa is C, F, H, I, K, M, N, P, V, or W
FGLNISXL

SEQ ID NO: 876 - protein, 8 aa, Artificial Sequence
  Description of Artificial Sequence: Synthetic Peptide
  SITE (7)..(7): Xaa is A, D, M, R, or Y
FGLNLSXL

SEQ ID NO: 877 - protein, 8 aa, Artificial Sequence
  Description of Artificial Sequence: Synthetic Peptide
  SITE (7)..(7): Xaa is A, C, D, E, F, G, H, I, L, M, P, Q, R, S, or W
FGLQIDXI

SEQ ID NO: 878 - protein, 8 aa, Artificial Sequence
  Description of Artificial Sequence: Synthetic Peptide
  SITE (7)..(7): Xaa is A, C, D, F, H, I, K, L, N, P, Q, R, S, T, V, W, or Y
FGLQLDXI

SEQ ID NO: 879 - protein, 8 aa, Artificial Sequence
  Description of Artificial Sequence: Synthetic Peptide
  SITE (7)..(7): Xaa is C, D, E ,F ,G, H, L, M, P, R, T, W, or Y
FGLQIDXL

SEQ ID NO: 880 - protein, 8 aa, Artificial Sequence
  Description of Artificial Sequence: Synthetic Peptide
  SITE (7)..(7): Xaa is A, C, E, H, I, K, M, N, P, R, or W
FGLQLDXL

SEQ ID NO: 881 - protein, 8 aa, Artificial Sequence
  Description of Artificial Sequence: Synthetic Peptide
  SITE (7)..(7): Xaa is D, F, H, I, K, L, M, N, P, Q, R, T, V, W, or Y
FGLQIRXI

SEQ ID NO: 882 - protein, 8 aa, Artificial Sequence
  Description of Artificial Sequence: Synthetic Peptide
  SITE (7)..(7): Xaa is A, C, D, F, G, H, I, L, M, N, P, Q, T, v, W, or Y
FGLQLRXI

SEQ ID NO: 883 - protein, 8 aa, Artificial Sequence
  Description of Artificial Sequence: Synthetic Peptide
  SITE (7)..(7): Xaa is A, C, D, E, F, G, H, I, K, L, M, N, P, Q, S, T, V, W, or Y
FGLQIRXL

SEQ ID NO: 884 - protein, 8 aa, Artificial Sequence
  Description of Artificial Sequence: Synthetic Peptide
  SITE (7)..(7): Xaa is A, D, F, G, H, I, M, P, T, or V
FGLQLRXL

SEQ ID NO: 885 - protein, 8 aa, Artificial Sequence
  Description of Artificial Sequence: Synthetic Peptide
  SITE (7)..(7): Xaa is C, F, G, H, L, M, P, Q, W, or Y
FGLQISXI

SEQ ID NO: 886 - protein, 8 aa, Artificial Sequence
  Description of Artificial Sequence: Synthetic Peptide
  SITE (7)..(7): Xaa is A, C, E, H, M, N ,Q, V, W, or Y
FGLQLSXI

SEQ ID NO: 887 - protein, 8 aa, Artificial Sequence
  Description of Artificial Sequence: Synthetic Peptide
  SITE (7)..(7): Xaa is A, C, D, H, L, M, N, P, or W
FGLQISXL

SEQ ID NO: 888 - protein, 8 aa, Artificial Sequence
  Description of Artificial Sequence: Synthetic Peptide
  SITE (7)..(7): Xaa is A, C, H, I, K, N, P, or W
FGLQLSXL

SEQ ID NO: 889 - protein, 8 aa, Artificial Sequence
  Description of Artificial Sequence: Synthetic Peptide
  SITE (7)..(7): Xaa is H, C, I, P, W, or Y
FGLSLDXI

SEQ ID NO: 890 - protein, 8 aa, Artificial Sequence
  Description of Artificial Sequence: Synthetic Peptide
  SITE (7)..(7): Xaa is C, G, H, W, or Y
FGLSIDXL

SEQ ID NO: 891 - protein, 8 aa, Artificial Sequence
  Description of Artificial Sequence: Synthetic Peptide
  SITE (7)..(7): Xaa is A, C, E, F, H, L, M, P, R, or V
FGLSIRXI

SEQ ID NO: 892 - protein, 8 aa, Artificial Sequence
  Description of Artificial Sequence: Synthetic Peptide
  SITE (7)..(7): Xaa is C, I, K, M, P, Q, R, S, W, or Y
FGLSLRXI

SEQ ID NO: 893 - protein, 8 aa, Artificial Sequence
  Description of Artificial Sequence: Synthetic Peptide
  SITE (7)..(7): Xaa is A, C, G, H, I, K, M, N, P, R, S, V, or W
FGLSIRXL

SEQ ID NO: 894 - protein, 8 aa, Artificial Sequence
  Description of Artificial Sequence: Synthetic Peptide
  SITE (7)..(7): Xaa is C, F, H, I, N, or P
FGLSLRXL

SEQ ID NO: 895 - protein, 8 aa, Artificial Sequence
  Description of Artificial Sequence: Synthetic Peptide
  SITE (7)..(7): Xaa is H, K, Q, or R
FGLSISXI

SEQ ID NO: 896 - protein, 8 aa, Artificial Sequence
  Description of Artificial Sequence: Synthetic Peptide
  SITE (7)..(7): Xaa is G or N
FGLSLSXI

SEQ ID NO: 897 - protein, 8 aa, Artificial Sequence
  Description of Artificial Sequence: Synthetic Peptide
  SITE (7)..(7): Xaa is C, H, R, T, or W
FGLSISXL

SEQ ID NO: 898 - protein, 8 aa, Artificial Sequence
  Description of Artificial Sequence: Synthetic Peptide
  SITE (7)..(7): Xaa is N or W
FGLSLSXL

SEQ ID NO: 899 - protein, 8 aa, Artificial Sequence
  Description of Artificial Sequence: Synthetic Peptide
  SITE (7)..(7): Xaa is A, C, D, F, G, H, I, K, L, P, Q, R, W or Y
FGNDIDXI

SEQ ID NO: 900 - protein, 8 aa, Artificial Sequence
  Description of Artificial Sequence: Synthetic Peptide
  SITE (7)..(7): Xaa is C, D, E, H, Q, S, W, or Y
FGNDLDXI

SEQ ID NO: 901 - protein, 8 aa, Artificial Sequence
  Description of Artificial Sequence: Synthetic Peptide
  SITE (7)..(7): Xaa is A, C, D, E, F, G, H, I, K, L, or W
FGNDIDXL

SEQ ID NO: 902 - protein, 8 aa, Artificial Sequence
  Description of Artificial Sequence: Synthetic Peptide
  SITE (7)..(7): Xaa is C, G, H, T, W, or Y
FGNDLDXL

SEQ ID NO: 903 - protein, 8 aa, Artificial Sequence
  Description of Artificial Sequence: Synthetic Peptide
  SITE (7)..(7): Xaa is C, D, E, F, G, H ,I, K, L, M, N, P, R, V, or W
FGNDIRXI

SEQ ID NO: 904 - protein, 8 aa, Artificial Sequence
  Description of Artificial Sequence: Synthetic Peptide
  SITE (7)..(7): Xaa is C, D, F, G, H, I, K, M, N, P, Q, R, S, V, or Y
FGNDLRXI

SEQ ID NO: 905 - protein, 8 aa, Artificial Sequence
  Description of Artificial Sequence: Synthetic Peptide
  SITE (7)..(7): Xaa is A, C, E, G, H ,M, P, Q, R, T, V, W, or Y
FGNDIRXL

SEQ ID NO: 906 - protein, 8 aa, Artificial Sequence
  Description of Artificial Sequence: Synthetic Peptide
  SITE (7)..(7): Xaa is A, C, D, E, F, H, I, M, N, P, Q, W, or Y
FGNDLRXL

SEQ ID NO: 907 - protein, 8 aa, Artificial Sequence
  Description of Artificial Sequence: Synthetic Peptide
  SITE (7)..(7): Xaa is C, H, L, M, N, Q, R, T, W, or Y
FGNDISXI

SEQ ID NO: 908 - protein, 8 aa, Artificial Sequence
  Description of Artificial Sequence: Synthetic Peptide
  SITE (7)..(7): Xaa is C, D, F ,G, M, N, Q, R, S, V, W, or Y
FGNDLSXI

SEQ ID NO: 909 - protein, 8 aa, Artificial Sequence
  Description of Artificial Sequence: Synthetic Peptide
  SITE (7)..(7): Xaa is C, H, M, N, R, V, W, or Y
FGNDISXL

SEQ ID NO: 910 - protein, 8 aa, Artificial Sequence
  Description of Artificial Sequence: Synthetic Peptide
  SITE (7)..(7): Xaa is C, D, E, I, Q, R, S, or W
FGNDLSXL

SEQ ID NO: 911 - protein, 8 aa, Artificial Sequence
  Description of Artificial Sequence: Synthetic Peptide
  SITE (7)..(7): Xaa is A, D, E, F, G, H, I, L, M, N, P, Q, W, or Y
FGNEIDXI

SEQ ID NO: 912 - protein, 8 aa, Artificial Sequence
  Description of Artificial Sequence: Synthetic Peptide
  SITE (7)..(7): Xaa is A, C, E, F, G, H, I, M, P, Q, R, S, T, or Y
FGNELDXI

SEQ ID NO: 913 - protein, 8 aa, Artificial Sequence
  Description of Artificial Sequence: Synthetic Peptide
  SITE (7)..(7): Xaa is A, C, D, E, F, H, I, K, M, N, R, or W
FGNEIDXL

SEQ ID NO: 914 - protein, 8 aa, Artificial Sequence
  Description of Artificial Sequence: Synthetic Peptide
  SITE (7)..(7): Xaa is A, C, D, E, F, G, M, N, P, Q, T, W, or Y
FGNELDXL

SEQ ID NO: 915 - protein, 8 aa, Artificial Sequence
  Description of Artificial Sequence: Synthetic Peptide
  SITE (7)..(7): Xaa is A, C, F, G, H, I, K, M, N, P, Q, T, V, or Y
FGNELRXI

SEQ ID NO: 916 - protein, 8 aa, Artificial Sequence
  Description of Artificial Sequence: Synthetic Peptide
  SITE (7)..(7): Xaa is A, C, D, E, F, G, H ,I ,K, M, N, P, Q, R, T, V, W, or Y
FGNEIRXL

SEQ ID NO: 917 - protein, 8 aa, Artificial Sequence
  Description of Artificial Sequence: Synthetic Peptide
  SITE (7)..(7): Xaa is A, C, F, G, K, L, M, N, P, R, S, T, V, W, or Y
FGNELRXL

SEQ ID NO: 918 - protein, 8 aa, Artificial Sequence
  Description of Artificial Sequence: Synthetic Peptide
  SITE (7)..(7): Xaa is A, C, I, M, N, Q, T, W, or Y
FGNEISXI

SEQ ID NO: 919 - protein, 8 aa, Artificial Sequence
  Description of Artificial Sequence: Synthetic Peptide
  SITE (7)..(7): Xaa is C, D, H, I, K, P, R, S, V, W, or Y
FGNELSXI

SEQ ID NO: 920 - protein, 8 aa, Artificial Sequence
  Description of Artificial Sequence: Synthetic Peptide
  SITE (7)..(7): Xaa is C, E, G, H, K, M, N, R, T, or Y
FGNEISXL

SEQ ID NO: 921 - protein, 8 aa, Artificial Sequence
  Description of Artificial Sequence: Synthetic Peptide
  SITE (7)..(7): Xaa is A, C, G, H, I, M, W, or Y
FGNELSXL

SEQ ID NO: 922 - protein, 8 aa, Artificial Sequence
  Description of Artificial Sequence: Synthetic Peptide
  SITE (7)..(7): Xaa is A, C, D, F, G, H, I, K, M, N, P, Q, R, T, V, W, or Y
FGNNIDXI

SEQ ID NO: 923 - protein, 8 aa, Artificial Sequence
  Description of Artificial Sequence: Synthetic Peptide
  SITE (7)..(7): Xaa is C, D, F, G ,H, K, M, N, P, Q, R, S, T, or W
FGNNLDXI

SEQ ID NO: 924 - protein, 8 aa, Artificial Sequence
  Description of Artificial Sequence: Synthetic Peptide
  SITE (7)..(7): Xaa is A, C, D, E, F, G, H, K, M, N, P, R, S, T, W, or Y
FGNNIDXL

SEQ ID NO: 925 - protein, 8 aa, Artificial Sequence
  Description of Artificial Sequence: Synthetic Peptide
  SITE (7)..(7): Xaa is C, E, F, H, K, M, P, or Y
FGNNLDXL

SEQ ID NO: 926 - protein, 8 aa, Artificial Sequence
  Description of Artificial Sequence: Synthetic Peptide
  SITE (7)..(7): Xaa is C, E, F, G, H, I, K, M, P, Q, R, W, or Y
FGNNIRXI

SEQ ID NO: 927 - protein, 8 aa, Artificial Sequence
  Description of Artificial Sequence: Synthetic Peptide
  SITE (7)..(7): Xaa is A, C, E, F, G, I, K, L, M, N, P, Q, R, T, V, W, or Y
FGNNLRXI

SEQ ID NO: 928 - protein, 8 aa, Artificial Sequence
  Description of Artificial Sequence: Synthetic Peptide
  SITE (7)..(7): Xaa is A, C, D, E, F, G, H, I, L, M, N, P, Q, S, T, V, or W
FGNNIRXL

SEQ ID NO: 929 - protein, 8 aa, Artificial Sequence
  Description of Artificial Sequence: Synthetic Peptide
  SITE (7)..(7): Xaa is A, C, D, E, F, G, H, K, M, N, P, Q, R, S, V, W, or Y
FGNNLRXL

SEQ ID NO: 930 - protein, 8 aa, Artificial Sequence
  Description of Artificial Sequence: Synthetic Peptide
  SITE (7)..(7): Xaa is A, C, E, F, G, H, K, L, M, N, P, Q, R, S, T, W, or Y
FGNNISXI

SEQ ID NO: 931 - protein, 8 aa, Artificial Sequence
  Description of Artificial Sequence: Synthetic Peptide
  SITE (7)..(7): Xaa is A, C, D, E, F, K, M, R, T, V, W, or Y
FGNNLSXI

SEQ ID NO: 932 - protein, 8 aa, Artificial Sequence
  Description of Artificial Sequence: Synthetic Peptide
  SITE (7)..(7): Xaa is C, D, E, F, G, H, M, N, P, R, W, or Y
FGNNISXL

SEQ ID NO: 933 - protein, 8 aa, Artificial Sequence
  Description of Artificial Sequence: Synthetic Peptide
  SITE (7)..(7): Xaa is A, C, E, F, H, K, M, N, P, R, V, W, or Y
FGNNLSXL

SEQ ID NO: 934 - protein, 8 aa, Artificial Sequence
  Description of Artificial Sequence: Synthetic Peptide
  SITE (7)..(7): Xaa is A, C, D, F, G, H, I, K, M, N, P, Q, S, or Y
FGNQIDXI

SEQ ID NO: 935 - protein, 8 aa, Artificial Sequence
  Description of Artificial Sequence: Synthetic Peptide
  SITE (7)..(7): Xaa is A, C, D, E, F, G, H, I, K, L, M, P, Q, V, W, or Y
FGNQLDXI

SEQ ID NO: 936 - protein, 8 aa, Artificial Sequence
  Description of Artificial Sequence: Synthetic Peptide
  SITE (7)..(7): Xaa is C, E, F, G, I, L, M, N, R, S, V, W, or Y
FGNQIDXL

SEQ ID NO: 937 - protein, 8 aa, Artificial Sequence
  Description of Artificial Sequence: Synthetic Peptide
  SITE (7)..(7): Xaa is C, D, K, M, P, Q, S, T, or V
FGNQLDXL

SEQ ID NO: 938 - protein, 8 aa, Artificial Sequence
  Description of Artificial Sequence: Synthetic Peptide
  SITE (7)..(7): Xaa is A, C, D, E, G, H, I, K, L, M, N, P, R, T, V, W, or Y
FGNQIRXI

SEQ ID NO: 939 - protein, 8 aa, Artificial Sequence
  Description of Artificial Sequence: Synthetic Peptide
  SITE (7)..(7): Xaa is A, C, D, H, I, K, L, M, P, Q, R, S, T, V ,W, or Y
FGNQLRXI

SEQ ID NO: 940 - protein, 8 aa, Artificial Sequence
  Description of Artificial Sequence: Synthetic Peptide
  SITE (7)..(7): Xaa is A, C, D, E, H, K, P, Q, R, or W
FGNQIRXL

SEQ ID NO: 941 - protein, 8 aa, Artificial Sequence
  Description of Artificial Sequence: Synthetic Peptide
  SITE (7)..(7): Xaa is A, C, F, G, H, M, N, P, Q, T, W, or Y
FGNQLRXL

SEQ ID NO: 942 - protein, 8 aa, Artificial Sequence
  Description of Artificial Sequence: Synthetic Peptide
  SITE (7)..(7): Xaa is A, C, F, G, H, M, N, S, T, V, W, or Y
FGNQISXI

SEQ ID NO: 943 - protein, 8 aa, Artificial Sequence
  Description of Artificial Sequence: Synthetic Peptide
  SITE (7)..(7): Xaa is A, C, D, F, G, H, I, K, M, N, Q, R, S,T, V, W, or Y
FGNQLSXI

SEQ ID NO: 944 - protein, 8 aa, Artificial Sequence
  Description of Artificial Sequence: Synthetic Peptide
  SITE (7)..(7): Xaa is C, D,E, H, I, L, M, N, P, Q, R, S, W, or Y
FGNQISXL

SEQ ID NO: 945 - protein, 8 aa, Artificial Sequence
  Description of Artificial Sequence: Synthetic Peptide
  SITE (7)..(7): Xaa is A, C, F, G, H, M, P, T, or Y
FGNQLSXL

SEQ ID NO: 946 - protein, 8 aa, Artificial Sequence
  Description of Artificial Sequence: Synthetic Peptide
  SITE (7)..(7): Xaa is A, C, D, G, H, I, K, L, M, P, R, S, V, or Y
FGNSIDXI

SEQ ID NO: 947 - protein, 8 aa, Artificial Sequence
  Description of Artificial Sequence: Synthetic Peptide
  SITE (7)..(7): Xaa is A, C, G, H, I, K, M, Q, R, T, V, W, or Y
FGNSLDXI

SEQ ID NO: 948 - protein, 8 aa, Artificial Sequence
  Description of Artificial Sequence: Synthetic Peptide
  SITE (7)..(7): Xaa is C, D, F, H, M, N, P, R, S, V, W, or Y
FGNSIDXL

SEQ ID NO: 949 - protein, 8 aa, Artificial Sequence
  Description of Artificial Sequence: Synthetic Peptide
  SITE (7)..(7): Xaa is A, C, F, H, I, K, L, M, P, Q, T, V, W, or Y
FGNSLDXL

SEQ ID NO: 950 - protein, 8 aa, Artificial Sequence
  Description of Artificial Sequence: Synthetic Peptide
  SITE (7)..(7): Xaa is A, C, D, F, G, H, K, L, N, P, Q, R, T, V, W, or Y
FGNSIRXI

SEQ ID NO: 951 - protein, 8 aa, Artificial Sequence
  Description of Artificial Sequence: Synthetic Peptide
  SITE (7)..(7): Xaa is C, D, E, F, H, K, M, N, P, Q, T, V, or Y
FGNSLRXI

SEQ ID NO: 952 - protein, 8 aa, Artificial Sequence
  Description of Artificial Sequence: Synthetic Peptide
  SITE (7)..(7): Xaa is A, C, D, G, I, K, M, P, Q, R, T, W, or Y
FGNSIRXL

SEQ ID NO: 953 - protein, 8 aa, Artificial Sequence
  Description of Artificial Sequence: Synthetic Peptide
  SITE (7)..(7): Xaa is D, L, M, N, P, W, or Y
FGNSLRXL

SEQ ID NO: 954 - protein, 8 aa, Artificial Sequence
  Description of Artificial Sequence: Synthetic Peptide
  SITE (7)..(7): Xaa is C, D, F, H, K, L, M, P, R, V, or W
FGNSISXI

SEQ ID NO: 955 - protein, 8 aa, Artificial Sequence
  Description of Artificial Sequence: Synthetic Peptide
  SITE (7)..(7): Xaa is C, E, H, K, M, P, R, V, W, or Y
FGNSLSXI

SEQ ID NO: 956 - protein, 8 aa, Artificial Sequence
  Description of Artificial Sequence: Synthetic Peptide
  SITE (7)..(7): Xaa is C, G, H, K, V, or W
FGNSISXL

SEQ ID NO: 957 - protein, 8 aa, Artificial Sequence
  Description of Artificial Sequence: Synthetic Peptide
  SITE (7)..(7): Xaa is A, D, E, F, K, M, W, or Y
FGNSLSXL

SEQ ID NO: 958 - protein, 8 aa, Artificial Sequence
  Description of Artificial Sequence: Synthetic Peptide
  SITE (7)..(7): Xaa is A, C, D, E, F, G, H, I, L, M, N, Q, V, W, or Y
FGSDIDXI

SEQ ID NO: 959 - protein, 8 aa, Artificial Sequence
  Description of Artificial Sequence: Synthetic Peptide
  SITE (7)..(7): Xaa is C, D, H, M, N, V, W, or Y
FGSDLDXI

SEQ ID NO: 960 - protein, 8 aa, Artificial Sequence
  Description of Artificial Sequence: Synthetic Peptide
  SITE (7)..(7): Xaa is A, D, F, G, H, K, L, M, N, Q, S, or W
FGSDIDXL

SEQ ID NO: 961 - protein, 8 aa, Artificial Sequence
  Description of Artificial Sequence: Synthetic Peptide
  SITE (7)..(7): Xaa is C, H, M, or W
FGSDLDXL

SEQ ID NO: 962 - protein, 8 aa, Artificial Sequence
  Description of Artificial Sequence: Synthetic Peptide
  SITE (7)..(7): Xaa is A, C, D, E, F, I, K, L, M, N, P, Q, R, S, T, V, W, or Y
FGSDIRXI

SEQ ID NO: 963 - protein, 8 aa, Artificial Sequence
  Description of Artificial Sequence: Synthetic Peptide
  SITE (7)..(7): Xaa is C, D, E, F, G, H, I, K, M, N, P, Q, S, T, V, or Y
FGSDLRXI

SEQ ID NO: 964 - protein, 8 aa, Artificial Sequence
  Description of Artificial Sequence: Synthetic Peptide
  SITE (7)..(7): Xaa is A, C, D, F, H, M, P, R, T, V, W, or Y
FGSDIRXL

SEQ ID NO: 965 - protein, 8 aa, Artificial Sequence
  Description of Artificial Sequence: Synthetic Peptide
  SITE (7)..(7): Xaa is G, K, N, P, Q, or W
FGSDLRXL

SEQ ID NO: 966 - protein, 8 aa, Artificial Sequence
  Description of Artificial Sequence: Synthetic Peptide
  SITE (7)..(7): Xaa is C, D, F, H, M, N, Q, R, V, W, or Y
FGSDISXI

SEQ ID NO: 967 - protein, 8 aa, Artificial Sequence
  Description of Artificial Sequence: Synthetic Peptide
  SITE (7)..(7): Xaa is A, C, E, F, H, I, T, W, or Y
FGSDLSXI

SEQ ID NO: 968 - protein, 8 aa, Artificial Sequence
  Description of Artificial Sequence: Synthetic Peptide
  SITE (7)..(7): Xaa is C, D, F, H, M, N, Q, R, V, W, or Y
FGSDISXL

SEQ ID NO: 969 - protein, 8 aa, Artificial Sequence
  Description of Artificial Sequence: Synthetic Peptide
  SITE (7)..(7): Xaa is C, M, Q, or V
FGSDLSXL

SEQ ID NO: 970 - protein, 8 aa, Artificial Sequence
  Description of Artificial Sequence: Synthetic Peptide
  SITE (7)..(7): Xaa is C, D, E, F, H, K, L, N, P, Q, T, V, W, or Y
FGSEIDXI

SEQ ID NO: 971 - protein, 8 aa, Artificial Sequence
  Description of Artificial Sequence: Synthetic Peptide
  SITE (7)..(7): Xaa is C, F, H, I, L, M, R, S, T, W, or Y
FGSELDXI

SEQ ID NO: 972 - protein, 8 aa, Artificial Sequence
  Description of Artificial Sequence: Synthetic Peptide
  SITE (7)..(7): Xaa is E, H, I, K, M, N, P, Q, T, W, or Y
FGSEIDXL

SEQ ID NO: 973 - protein, 8 aa, Artificial Sequence
  Description of Artificial Sequence: Synthetic Peptide
  SITE (7)..(7): Xaa is C, K, L, N, P, Q, V, W, or Y
FGSELDXL

SEQ ID NO: 974 - protein, 8 aa, Artificial Sequence
  Description of Artificial Sequence: Synthetic Peptide
  SITE (7)..(7): Xaa is F, G, H, I, K, L, M, Q, R, S, T, V, W, or Y
FGSEIRXI

SEQ ID NO: 975 - protein, 8 aa, Artificial Sequence
  Description of Artificial Sequence: Synthetic Peptide
  SITE (7)..(7): Xaa is A, C, D, E, F, G, H, I, L, M, N, P, Q, R, S, T, V, W, or Y
FGSELRXI

SEQ ID NO: 976 - protein, 8 aa, Artificial Sequence
  Description of Artificial Sequence: Synthetic Peptide
  SITE (7)..(7): Xaa is C, G, H, I, K, M, P, R, W, or Y
FGSEIRXL

SEQ ID NO: 977 - protein, 8 aa, Artificial Sequence
  Description of Artificial Sequence: Synthetic Peptide
  SITE (7)..(7): Xaa is C, H, M, P, V, W, or Y
FGSELRXL

SEQ ID NO: 978 - protein, 8 aa, Artificial Sequence
  Description of Artificial Sequence: Synthetic Peptide
  SITE (7)..(7): Xaa is C, G, H, I, K, L, M, N, P, Q, R, T, or W
FGSEISXI

SEQ ID NO: 979 - protein, 8 aa, Artificial Sequence
  Description of Artificial Sequence: Synthetic Peptide
  SITE (7)..(7): Xaa is C, F, M, Q, R, V, W, or Y
FGSELSXI

SEQ ID NO: 980 - protein, 8 aa, Artificial Sequence
  Description of Artificial Sequence: Synthetic Peptide
  SITE (7)..(7): Xaa is A, D, G, H, I, L, M, P, Q, T, or Y
FGSEISXL

SEQ ID NO: 981 - protein, 8 aa, Artificial Sequence
  Description of Artificial Sequence: Synthetic Peptide
  SITE (7)..(7): Xaa is C, E, H, K, M, N, Q, S, W, or Y
FGSELSXL

SEQ ID NO: 982 - protein, 8 aa, Artificial Sequence
  Description of Artificial Sequence: Synthetic Peptide
  SITE (7)..(7): Xaa is C, D, E, F, G, H, K, M, P, R, S, T, W, or Y
FGSNIDXI

SEQ ID NO: 983 - protein, 8 aa, Artificial Sequence
  Description of Artificial Sequence: Synthetic Peptide
  SITE (7)..(7): Xaa is A, C, D, F, G, H, I, L, M, N, P, Q, R, T, V, W or Y
FGSNLDXI

SEQ ID NO: 984 - protein, 8 aa, Artificial Sequence
  Description of Artificial Sequence: Synthetic Peptide
  SITE (7)..(7): Xaa is C, D, E, F, G, H, K, M, N, P, S, W, or Y
FGSNIDXL

SEQ ID NO: 985 - protein, 8 aa, Artificial Sequence
  Description of Artificial Sequence: Synthetic Peptide
  SITE (7)..(7): Xaa is A, C, E, F, H, I, M, N, P, Q, W, or Y
FGSNLDXL

SEQ ID NO: 986 - protein, 8 aa, Artificial Sequence
  Description of Artificial Sequence: Synthetic Peptide
  SITE (7)..(7): Xaa is A, C, D, E, G, H, K, L, M, P, Q, R, T, V, W, or Y
FGSNIRXI

SEQ ID NO: 987 - protein, 8 aa, Artificial Sequence
  Description of Artificial Sequence: Synthetic Peptide
  SITE (7)..(7): Xaa is C, E, F, H, K, M, N, P, Q, S, V, or W
FGSNLRXI

SEQ ID NO: 988 - protein, 8 aa, Artificial Sequence
  Description of Artificial Sequence: Synthetic Peptide
  SITE (7)..(7): Xaa is C, D, G, H, I, M, N, P, S, or W
FGSNIRXL

SEQ ID NO: 989 - protein, 8 aa, Artificial Sequence
  Description of Artificial Sequence: Synthetic Peptide
  SITE (7)..(7): Xaa is C, H, L, M, P, Q, R, S, W, or Y
FGSNLRXL

SEQ ID NO: 990 - protein, 8 aa, Artificial Sequence
  Description of Artificial Sequence: Synthetic Peptide
  SITE (7)..(7): Xaa is C, E, G, M, P, Q, R, S, T, or Y
FGSNISXI

SEQ ID NO: 991 - protein, 8 aa, Artificial Sequence
  Description of Artificial Sequence: Synthetic Peptide
  SITE (7)..(7): Xaa is D, F, N, P, Q, R, or V
FGSNLSXI

SEQ ID NO: 992 - protein, 8 aa, Artificial Sequence
  Description of Artificial Sequence: Synthetic Peptide
  SITE (7)..(7): Xaa is C, G, I, M, N, P, Q, R, S, or W
FGSNISXL

SEQ ID NO: 993 - protein, 8 aa, Artificial Sequence
  Description of Artificial Sequence: Synthetic Peptide
  SITE (7)..(7): Xaa is C, F, G, L, M, or T
FGSNLSXL

SEQ ID NO: 994 - protein, 8 aa, Artificial Sequence
  Description of Artificial Sequence: Synthetic Peptide
  SITE (7)..(7): Xaa is A, C, D, F, G, H, K, L, M, N, P, Q, R, S, T, V, W, or Y
FGSQIDXI

SEQ ID NO: 995 - protein, 8 aa, Artificial Sequence
  Description of Artificial Sequence: Synthetic Peptide
  SITE (7)..(7): Xaa is C, D, E, G, H, I, K, L, M, P, Q, S, V, W, or Y
FGSQLDXI

SEQ ID NO: 996 - protein, 8 aa, Artificial Sequence
  Description of Artificial Sequence: Synthetic Peptide
  SITE (7)..(7): Xaa is C, D, F, G, H, N, P, Q, W, or Y
FGSQIDXL

SEQ ID NO: 997 - protein, 8 aa, Artificial Sequence
  Description of Artificial Sequence: Synthetic Peptide
  SITE (7)..(7): Xaa is A, C, E, F, G, H, I, K, M, N, P, R, S, T, W, or Y
FGSQLDXL

SEQ ID NO: 998 - protein, 8 aa, Artificial Sequence
  Description of Artificial Sequence: Synthetic Peptide
  SITE (7)..(7): Xaa is C, D, E, F, H, K, L, M, N, P, Q, R, S, T, V, W, or Y
FGSQIRXI

SEQ ID NO: 999 - protein, 8 aa, Artificial Sequence
  Description of Artificial Sequence: Synthetic Peptide
  SITE (7)..(7): Xaa is A, C, D, E, G, H, I, K, M, N, P, Q, R, S, T, W, or Y
FGSQLRXI

SEQ ID NO: 1000 - protein, 8 aa, Artificial Sequence
  Description of Artificial Sequence: Synthetic Peptide
  SITE (7)..(7): Xaa is C, F, H, M, N, P, Q, R, or W
FGSQIRXL

SEQ ID NO: 1001 - protein, 8 aa, Artificial Sequence
  Description of Artificial Sequence: Synthetic Peptide
  SITE (7)..(7): Xaa is C, D, E, H, K, L, M, N, P, Q, S, W, or Y
FGSQLRXL

SEQ ID NO: 1002 - protein, 8 aa, Artificial Sequence
  Description of Artificial Sequence: Synthetic Peptide
  SITE (7)..(7): Xaa is C, D, F, H, I, L, N, P, Q, T, V, W, or Y
FGSQISXI

SEQ ID NO: 1003 - protein, 8 aa, Artificial Sequence
  Description of Artificial Sequence: Synthetic Peptide
  SITE (7)..(7): Xaa is C, F, H, I, M, N, P, R, S, V, W, or Y
FGSQLSXI

SEQ ID NO: 1004 - protein, 8 aa, Artificial Sequence
  Description of Artificial Sequence: Synthetic Peptide
  SITE (7)..(7): Xaa is C, E, F, G, H, I, K, N, P, Q, R, S, V, or Y
FGSQISXL

SEQ ID NO: 1005 - protein, 8 aa, Artificial Sequence
  Description of Artificial Sequence: Synthetic Peptide
  SITE (7)..(7): Xaa is E, F, H, I, K, M, P, V, W, or Y
FGSQLSXL

SEQ ID NO: 1006 - protein, 8 aa, Artificial Sequence
  Description of Artificial Sequence: Synthetic Peptide
  SITE (7)..(7): Xaa is C, D, E, F, G, H, L, M, P, Q, S, T, V, W, or Y
FGSSIDXI

SEQ ID NO: 1007 - protein, 8 aa, Artificial Sequence
  Description of Artificial Sequence: Synthetic Peptide
  SITE (7)..(7): Xaa is C, F, G H, I, K, M, P, or W
FGSSLDXI

SEQ ID NO: 1008 - protein, 8 aa, Artificial Sequence
  Description of Artificial Sequence: Synthetic Peptide
  SITE (7)..(7): Xaa is A, C, D, F, H, N, P, S, T V, or Y
FGSSIDXL

SEQ ID NO: 1009 - protein, 8 aa, Artificial Sequence
  Description of Artificial Sequence: Synthetic Peptide
  SITE (7)..(7): Xaa is C, E, G, H, M, P, Q, W, or Y
FGSSLDXL

SEQ ID NO: 1010 - protein, 8 aa, Artificial Sequence
  Description of Artificial Sequence: Synthetic Peptide
  SITE (7)..(7): Xaa is A, C, G, H, I, K, P, R, W, or Y
FGSSIRXI

SEQ ID NO: 1011 - protein, 8 aa, Artificial Sequence
  Description of Artificial Sequence: Synthetic Peptide
  SITE (7)..(7): Xaa is C, D, F, H, L, M, N, Q, W, or Y
FGSSLRXI

SEQ ID NO: 1012 - protein, 8 aa, Artificial Sequence
  Description of Artificial Sequence: Synthetic Peptide
  SITE (7)..(7): Xaa is A, C, D, F, G, H, I, K, L, T, or V
FGSSIRXL

SEQ ID NO: 1013 - protein, 8 aa, Artificial Sequence
  Description of Artificial Sequence: Synthetic Peptide
  SITE (7)..(7): Xaa is C, D, E, H, M, N, Q, W, or Y
FGSSLRXL

SEQ ID NO: 1014 - protein, 8 aa, Artificial Sequence
  Description of Artificial Sequence: Synthetic Peptide
  SITE (7)..(7): Xaa is A, H, K, M, P, Q, or Y
FGSSISXI

SEQ ID NO: 1015 - protein, 8 aa, Artificial Sequence
  Description of Artificial Sequence: Synthetic Peptide
  SITE (7)..(7): Xaa is A, E, H, P, T, or V
FGSSLSXI

SEQ ID NO: 1016 - protein, 8 aa, Artificial Sequence
  Description of Artificial Sequence: Synthetic Peptide
  SITE (7)..(7): Xaa is C, F, G, P, R, W, or Y
FGSSISXL

SEQ ID NO: 1017 - protein, 8 aa, Artificial Sequence
  Description of Artificial Sequence: Synthetic Peptide
  SITE (7)..(7): Xaa is D, N, or W
FGSSLSXL

SEQ ID NO: 1018 - protein, 8 aa, Artificial Sequence
  Description of Artificial Sequence: Synthetic Peptide
  SITE (7)..(7): Xaa is C, D, F, G, H, I, L, M, N, P, Q, T, V, or W
FKADIDXI

SEQ ID NO: 1019 - protein, 8 aa, Artificial Sequence
  Description of Artificial Sequence: Synthetic Peptide
  SITE (7)..(7): Xaa is C, D, F, K, M, N, P, Q, R, W, or Y
FKADLDXI

SEQ ID NO: 1020 - protein, 8 aa, Artificial Sequence
  Description of Artificial Sequence: Synthetic Peptide
  SITE (7)..(7): Xaa is A, C, G, H, I, M, S, T, V, or W
FKADIDXL

SEQ ID NO: 1021 - protein, 8 aa, Artificial Sequence
  Description of Artificial Sequence: Synthetic Peptide
  SITE (7)..(7): Xaa is C, D, E, H, L, M, Q, W, or Y
FKADLDXL

SEQ ID NO: 1022 - protein, 8 aa, Artificial Sequence
  Description of Artificial Sequence: Synthetic Peptide
  SITE (7)..(7): Xaa is C, E, F, G, I, L, M, P, Q, T, V, or W
FKADIRXI

SEQ ID NO: 1023 - protein, 8 aa, Artificial Sequence
  Description of Artificial Sequence: Synthetic Peptide
  SITE (7)..(7): Xaa is A, C, E, F, G, I, K, L, M, Q, S, T, W, or Y
FKADLRXI

SEQ ID NO: 1024 - protein, 8 aa, Artificial Sequence
  Description of Artificial Sequence: Synthetic Peptide
  SITE (7)..(7): Xaa is C, D, F, H, Q, V, or W
FKADIRXL

SEQ ID NO: 1025 - protein, 8 aa, Artificial Sequence
  Description of Artificial Sequence: Synthetic Peptide
  SITE (7)..(7): Xaa is C, F, I, M, N, Q, T, V, W, or Y
FKADLRXL

SEQ ID NO: 1026 - protein, 8 aa, Artificial Sequence
  Description of Artificial Sequence: Synthetic Peptide
  SITE (7)..(7): Xaa is C, E, I, K, M, P, R, T, W, or Y
FKADISXI

SEQ ID NO: 1027 - protein, 8 aa, Artificial Sequence
  Description of Artificial Sequence: Synthetic Peptide
  SITE (7)..(7): Xaa is C, D, F, M, P, R, W, or Y
FKADLSXI

SEQ ID NO: 1028 - protein, 8 aa, Artificial Sequence
  Description of Artificial Sequence: Synthetic Peptide
  SITE (7)..(7): Xaa is C, F, H, M, P, S, T, V, or W
FKADISXL

SEQ ID NO: 1029 - protein, 8 aa, Artificial Sequence
  Description of Artificial Sequence: Synthetic Peptide
  SITE (7)..(7): Xaa is I, M, or W
FKADLSXL

SEQ ID NO: 1030 - protein, 8 aa, Artificial Sequence
  Description of Artificial Sequence: Synthetic Peptide
  SITE (7)..(7): Xaa is A, C, D, F, H, I, M, Q, R, T, V, W, or Y
FKAEIDXI

SEQ ID NO: 1031 - protein, 8 aa, Artificial Sequence
  Description of Artificial Sequence: Synthetic Peptide
  SITE (7)..(7): Xaa is C, F, H, M, N, P, V, W, or Y
FKAELDXI

SEQ ID NO: 1032 - protein, 8 aa, Artificial Sequence
  Description of Artificial Sequence: Synthetic Peptide
  SITE (7)..(7): Xaa is D, I, or W
FKAEIDXL

SEQ ID NO: 1033 - protein, 8 aa, Artificial Sequence
  Description of Artificial Sequence: Synthetic Peptide
  SITE (7)..(7): Xaa is C, F, P, W, or Y
FKAELDXL

SEQ ID NO: 1034 - protein, 8 aa, Artificial Sequence
  Description of Artificial Sequence: Synthetic Peptide
  SITE (7)..(7): Xaa is A, C, D, E, F, G, H, I, L, M, N, P, Q, T, V, W, or Y
FKAEIRXI

SEQ ID NO: 1035 - protein, 8 aa, Artificial Sequence
  Description of Artificial Sequence: Synthetic Peptide
  SITE (7)..(7): Xaa is A, C, F, H, I, K, L, M, N, Q, S, T, V, W, or Y
FKAELRXI

SEQ ID NO: 1036 - protein, 8 aa, Artificial Sequence
  Description of Artificial Sequence: Synthetic Peptide
  SITE (7)..(7): Xaa is C, F, I, L, M, R, V, or W
FKAEIRXL

SEQ ID NO: 1037 - protein, 8 aa, Artificial Sequence
  Description of Artificial Sequence: Synthetic Peptide
  SITE (7)..(7): Xaa is C, D, F, I, K, M, N, P, V, W, or Y
FKAELRXL

SEQ ID NO: 1038 - protein, 8 aa, Artificial Sequence
  Description of Artificial Sequence: Synthetic Peptide
  SITE (7)..(7): Xaa is A, C, D, F, H, I, K, L, M, Q, R, T, or W
FKAEISXI

SEQ ID NO: 1039 - protein, 8 aa, Artificial Sequence
  Description of Artificial Sequence: Synthetic Peptide
  SITE (7)..(7): Xaa is C, D, E, I, M, N, P, R, S, T, W, or Y
FKAEISXL

SEQ ID NO: 1040 - protein, 8 aa, Artificial Sequence
  Description of Artificial Sequence: Synthetic Peptide
  SITE (7)..(7): Xaa is C, F, G, H, I, M, N, Q, T, V, W, or Y
FKAELSXL

SEQ ID NO: 1041 - protein, 8 aa, Artificial Sequence
  Description of Artificial Sequence: Synthetic Peptide
  SITE (7)..(7): Xaa is C, E, F, H, I, K, L, P, Q, T, V, W, or Y
FKANIDXI

SEQ ID NO: 1042 - protein, 8 aa, Artificial Sequence
  Description of Artificial Sequence: Synthetic Peptide
  SITE (7)..(7): Xaa is C, E, G, I, L, M, N, P, Q, R, S, V, W, or Y
FKANLDXI

SEQ ID NO: 1043 - protein, 8 aa, Artificial Sequence
  Description of Artificial Sequence: Synthetic Peptide
  SITE (7)..(7): Xaa is A, C, E, F, G, L, N, Q, S, W, or Y
FKANIDXL

SEQ ID NO: 1044 - protein, 8 aa, Artificial Sequence
  Description of Artificial Sequence: Synthetic Peptide
  SITE (7)..(7): Xaa is C, D, F, G, K, L, M, P, Q, S, T, V, W, or Y
FKANLDXL

SEQ ID NO: 1045 - protein, 8 aa, Artificial Sequence
  Description of Artificial Sequence: Synthetic Peptide
  SITE (7)..(7): Xaa is C, F, G, I, L, M, Q, R, T, W, or Y
FKANIRXI

SEQ ID NO: 1046 - protein, 8 aa, Artificial Sequence
  Description of Artificial Sequence: Synthetic Peptide
  SITE (7)..(7): Xaa is A, F, G, H, L, M, N, Q, S, T, W, or Y
FKANLRXI

SEQ ID NO: 1047 - protein, 8 aa, Artificial Sequence
  Description of Artificial Sequence: Synthetic Peptide
  SITE (7)..(7): Xaa is C, D, E, F, G, H, I, K, L, M, N, P, Q, S, T, V, or W
FKANIRXL

SEQ ID NO: 1048 - protein, 8 aa, Artificial Sequence
  Description of Artificial Sequence: Synthetic Peptide
  SITE (7)..(7): Xaa is C, D, E, F, H, K, M, P, Q, V, W, or Y
FKANLRXL

SEQ ID NO: 1049 - protein, 8 aa, Artificial Sequence
  Description of Artificial Sequence: Synthetic Peptide
  SITE (7)..(7): Xaa is A, C, D, E, F, H, I, L, P, Q, W, or Y
FKANISXI

SEQ ID NO: 1050 - protein, 8 aa, Artificial Sequence
  Description of Artificial Sequence: Synthetic Peptide
  SITE (7)..(7): Xaa is C, D, G, H, K, L, M, N, P, Q. T. or W
FKANLSXI

SEQ ID NO: 1051 - protein, 8 aa, Artificial Sequence
  Description of Artificial Sequence: Synthetic Peptide
  SITE (7)..(7): Xaa is A, C, D, E, F, G, H, K, M, N, S, T, or W
FKANISXL

SEQ ID NO: 1052 - protein, 8 aa, Artificial Sequence
  Description of Artificial Sequence: Synthetic Peptide
  SITE (7)..(7): Xaa is C, E, F, I, M, N, P, S, T, V, or W
FKANLSXL

SEQ ID NO: 1053 - protein, 8 aa, Artificial Sequence
  Description of Artificial Sequence: Synthetic Peptide
  SITE (7)..(7): Xaa is C, E, F, G, H, I, M, P, Q, R, S, V, or Y
FKAQIDXI

SEQ ID NO: 1054 - protein, 8 aa, Artificial Sequence
  Description of Artificial Sequence: Synthetic Peptide
  SITE (7)..(7): Xaa is C, H, I, L, M, N, P, S, T, V, W, or Y
FKAQLDXI

SEQ ID NO: 1055 - protein, 8 aa, Artificial Sequence
  Description of Artificial Sequence: Synthetic Peptide
  SITE (7)..(7): Xaa is C, D, F, G, H, I, K, L, M, Q, W, or Y
FKAQIDXL

SEQ ID NO: 1056 - protein, 8 aa, Artificial Sequence
  Description of Artificial Sequence: Synthetic Peptide
  SITE (7)..(7): Xaa is C, F, H, M, N, or P
FKAQLDXL

SEQ ID NO: 1057 - protein, 8 aa, Artificial Sequence
  Description of Artificial Sequence: Synthetic Peptide
  SITE (7)..(7): Xaa is C, D, E, F, H, I, K, L, M, N, P, Q, R, T, V, W, or Y
FKAQIRXI

SEQ ID NO: 1058 - protein, 8 aa, Artificial Sequence
  Description of Artificial Sequence: Synthetic Peptide
  SITE (7)..(7): Xaa is C, D, G, H, I, K, L, M, N, P, R, V, W, or Y
FKAQLRXI

SEQ ID NO: 1059 - protein, 8 aa, Artificial Sequence
  Description of Artificial Sequence: Synthetic Peptide
  SITE (7)..(7): Xaa is C, D, E, F, G, H, I, K, P, Q, R, S, T, V, W, or Y
FKAQIRXL

SEQ ID NO: 1060 - protein, 8 aa, Artificial Sequence
  Description of Artificial Sequence: Synthetic Peptide
  SITE (7)..(7): Xaa is C, D, F, G, H, N, P, Q, T, V, or W
FKAQLRXL

SEQ ID NO: 1061 - protein, 8 aa, Artificial Sequence
  Description of Artificial Sequence: Synthetic Peptide
  SITE (7)..(7): Xaa is C, D, E, G, H, K, L, P, Q, R, T, or Y
FKAQISXI

SEQ ID NO: 1062 - protein, 8 aa, Artificial Sequence
  Description of Artificial Sequence: Synthetic Peptide
  SITE (7)..(7): Xaa is A, C, E, F, I, K, M, P, Q, R, V, W, or Y
FKAQLSXI

SEQ ID NO: 1063 - protein, 8 aa, Artificial Sequence
  Description of Artificial Sequence: Synthetic Peptide
  SITE (7)..(7): Xaa is C, D, E, F ,G ,H, I, L, M, N, P, Q, T, V, W, or Y
FKAQISXL

SEQ ID NO: 1064 - protein, 8 aa, Artificial Sequence
  Description of Artificial Sequence: Synthetic Peptide
  SITE (7)..(7): Xaa is D, F, G, I, M, P, S, V, or W
FKAQLSXL

SEQ ID NO: 1065 - protein, 8 aa, Artificial Sequence
  Description of Artificial Sequence: Synthetic Peptide
  SITE (7)..(7): Xaa is C, F, H, M ,N, Q, S, T, or W
FKASIDXI

SEQ ID NO: 1066 - protein, 8 aa, Artificial Sequence
  Description of Artificial Sequence: Synthetic Peptide
  SITE (7)..(7): Xaa is C, F, G, H, M, N, Q, R, W, or Y
FKASLDXI

SEQ ID NO: 1067 - protein, 8 aa, Artificial Sequence
  Description of Artificial Sequence: Synthetic Peptide
  SITE (7)..(7): Xaa is C, F, H, I, M, N, P, or T
FKASIDXL

SEQ ID NO: 1068 - protein, 8 aa, Artificial Sequence
  Description of Artificial Sequence: Synthetic Peptide
  SITE (7)..(7): Xaa is C, F, M, N, Q, V, W, or Y
FKASLDXL

SEQ ID NO: 1069 - protein, 8 aa, Artificial Sequence
  Description of Artificial Sequence: Synthetic Peptide
  SITE (7)..(7): Xaa is A, C, D, E, F, G, H, I, L, M, N, Q, S, T, V, W, or Y
FKASIRXI

SEQ ID NO: 1070 - protein, 8 aa, Artificial Sequence
  Description of Artificial Sequence: Synthetic Peptide
  SITE (7)..(7): Xaa is C, D, E, F, H, I, Q, S, V, or Y
FKASLRXI

SEQ ID NO: 1071 - protein, 8 aa, Artificial Sequence
  Description of Artificial Sequence: Synthetic Peptide
  SITE (7)..(7): Xaa is C, D, E, H, I, K, L, M, P, Q, R, T, V ,W, or Y
FKASIRXL

SEQ ID NO: 1072 - protein, 8 aa, Artificial Sequence
  Description of Artificial Sequence: Synthetic Peptide
  SITE (7)..(7): Xaa is A, C, F, G, H, I, K, L, M, P, Q, S, T, V, W, or Y
FKASLRXL

SEQ ID NO: 1073 - protein, 8 aa, Artificial Sequence
  Description of Artificial Sequence: Synthetic Peptide
  SITE (7)..(7): Xaa is C, E, G, I, L, N, Q, R, T, V, W, or Y
FKASISXI

SEQ ID NO: 1074 - protein, 8 aa, Artificial Sequence
  Description of Artificial Sequence: Synthetic Peptide
  SITE (7)..(7): Xaa is C, E, H, M, P, Q, T, V, or W
FKASLSXI

SEQ ID NO: 1075 - protein, 8 aa, Artificial Sequence
  Description of Artificial Sequence: Synthetic Peptide
  SITE (7)..(7): Xaa is A, C, D, G, F, H, I, K, M, P, Q, R, T, or W
FKASISXL

SEQ ID NO: 1076 - protein, 8 aa, Artificial Sequence
  Description of Artificial Sequence: Synthetic Peptide
  SITE (7)..(7): Xaa is A, F, G, H, K, N, Q, S, T, or Y
FKASLSXL

SEQ ID NO: 1077 - protein, 8 aa, Artificial Sequence
  Description of Artificial Sequence: Synthetic Peptide
  SITE (7)..(7): Xaa is A, C, F, H, I, K, M, N, P, S, T, W, or Y
FKGDIDXI

SEQ ID NO: 1078 - protein, 8 aa, Artificial Sequence
  Description of Artificial Sequence: Synthetic Peptide
  SITE (7)..(7): Xaa is A, C, E, F, G, H, N, P, R, T, V, or Y
FKGDLDXI

SEQ ID NO: 1079 - protein, 8 aa, Artificial Sequence
  Description of Artificial Sequence: Synthetic Peptide
  SITE (7)..(7): Xaa is A, C, E, G, H, K, M, P, V, or W
FKGDIDXL

SEQ ID NO: 1080 - protein, 8 aa, Artificial Sequence
  Description of Artificial Sequence: Synthetic Peptide
  SITE (7)..(7): Xaa is C, D, H, I, L, M, P, V, or W
FKGDLDXL

SEQ ID NO: 1081 - protein, 8 aa, Artificial Sequence
  Description of Artificial Sequence: Synthetic Peptide
  SITE (7)..(7): Xaa is A, C, D, F, G, H, I, L, M, N, P, Q, R, T, V, W, or Y
FKGDIRXI

SEQ ID NO: 1082 - protein, 8 aa, Artificial Sequence
  Description of Artificial Sequence: Synthetic Peptide
  SITE (7)..(7): Xaa is A, C, D, F, H, I, K, L, M, P, Q, T, W, or Y
FKGDLRXI

SEQ ID NO: 1083 - protein, 8 aa, Artificial Sequence
  Description of Artificial Sequence: Synthetic Peptide
  SITE (7)..(7): Xaa is C, D, E, F, G, I, L, M, P, Q, S, T, W, or Y
FKGDIRXL

SEQ ID NO: 1084 - protein, 8 aa, Artificial Sequence
  Description of Artificial Sequence: Synthetic Peptide
  SITE (7)..(7): Xaa is C, I, K, L, P, Q, S, T, V, W, or Y
FKGDLRXL

SEQ ID NO: 1085 - protein, 8 aa, Artificial Sequence
  Description of Artificial Sequence: Synthetic Peptide
  SITE (7)..(7): Xaa is C, H, M, W, or Y
FKGDISXI

SEQ ID NO: 1086 - protein, 8 aa, Artificial Sequence
  Description of Artificial Sequence: Synthetic Peptide
  SITE (7)..(7): Xaa is A, C, D, N, P, Q, R, S, T, W, or Y
FKGDLSXI

SEQ ID NO: 1087 - protein, 8 aa, Artificial Sequence
  Description of Artificial Sequence: Synthetic Peptide
  SITE (7)..(7): Xaa is C, F, G, H, I, M, N, P, R, S, T, V, or W
FKGDISXL

SEQ ID NO: 1088 - protein, 8 aa, Artificial Sequence
  Description of Artificial Sequence: Synthetic Peptide
  SITE (7)..(7): Xaa is C, H, L, M, P, S, or W
FKGDLSXL

SEQ ID NO: 1089 - protein, 8 aa, Artificial Sequence
  Description of Artificial Sequence: Synthetic Peptide
  SITE (7)..(7): Xaa is A, C, D, E, G, H, I, K, L, M, P, R, S, T, W, or Y
FKGEIDXI

SEQ ID NO: 1090 - protein, 8 aa, Artificial Sequence
  Description of Artificial Sequence: Synthetic Peptide
  SITE (7)..(7): Xaa is A, C, D, E, F, H, M, P, Q, R, W, or Y
FKGELDXI

SEQ ID NO: 1091 - protein, 8 aa, Artificial Sequence
  Description of Artificial Sequence: Synthetic Peptide
  SITE (7)..(7): Xaa is C, D, F, H, P, Q, S, T, W,or Y
FKGEIDXL

SEQ ID NO: 1092 - protein, 8 aa, Artificial Sequence
  Description of Artificial Sequence: Synthetic Peptide
  SITE (7)..(7): Xaa is C, H, L, M, N, Q, V, W, or Y
FKGELDXL

SEQ ID NO: 1093 - protein, 8 aa, Artificial Sequence
  Description of Artificial Sequence: Synthetic Peptide
  SITE (7)..(7): Xaa is C, D, F, G, H, M, Q, W, or Y
FKGEIRXI

SEQ ID NO: 1094 - protein, 8 aa, Artificial Sequence
  Description of Artificial Sequence: Synthetic Peptide
  SITE (7)..(7): Xaa is C, D, I, M, N, P, Q, R, S, T, V, or W
FKGELRXI

SEQ ID NO: 1095 - protein, 8 aa, Artificial Sequence
  Description of Artificial Sequence: Synthetic Peptide
  SITE (7)..(7): Xaa is A, C, D, F, G, H, M, T, W, or Y
FKGEIRXL

SEQ ID NO: 1096 - protein, 8 aa, Artificial Sequence
  Description of Artificial Sequence: Synthetic Peptide
  SITE (7)..(7): Xaa is C, E, F, G, H, I, L, M, N, P, V, W, or Y
FKGELRXL

SEQ ID NO: 1097 - protein, 8 aa, Artificial Sequence
  Description of Artificial Sequence: Synthetic Peptide
  SITE (7)..(7): Xaa is C, D, E, H, K, M, P, and W
FKGEISXI

SEQ ID NO: 1098 - protein, 8 aa, Artificial Sequence
  Description of Artificial Sequence: Synthetic Peptide
  SITE (7)..(7): Xaa is A, C, F, G, H, I, K, L, M, P, R, S, T, V, and W
FKGELSXI

SEQ ID NO: 1099 - protein, 8 aa, Artificial Sequence
  Description of Artificial Sequence: Synthetic Peptide
  SITE (7)..(7): Xaa is C, F, G, I, M, N, Q, R, T, and Y
FKGEISXL

SEQ ID NO: 1100 - protein, 8 aa, Artificial Sequence
  Description of Artificial Sequence: Synthetic Peptide
  SITE (7)..(7): Xaa is C, G, H, K, M, N, P, T, V, W, and Y
FKGELSXL

SEQ ID NO: 1101 - protein, 8 aa, Artificial Sequence
  Description of Artificial Sequence: Synthetic Peptide
  SITE (7)..(7): Xaa is C, D, F, H, K, M, N, R, S, T, V, W, or Y
FKGNIDXI

SEQ ID NO: 1102 - protein, 8 aa, Artificial Sequence
  Description of Artificial Sequence: Synthetic Peptide
  SITE (7)..(7): Xaa is D, F, H, K, M, N, R, S, T, V, W, or Y
FKGNIDXI

SEQ ID NO: 1103 - protein, 8 aa, Artificial Sequence
  Description of Artificial Sequence: Synthetic Peptide
  SITE (7)..(7): Xaa is E, F, G, K, N, P, Q, R, S, T, or W
FKGNLDXI

SEQ ID NO: 1104 - protein, 8 aa, Artificial Sequence
  Description of Artificial Sequence: Synthetic Peptide
  SITE (7)..(7): Xaa is A, C, G, H, K, L, M, P, Q, R, S, V, or W
FKGNIDXL

SEQ ID NO: 1105 - protein, 8 aa, Artificial Sequence
  Description of Artificial Sequence: Synthetic Peptide
  SITE (7)..(7): Xaa is C, F, H, K, M, N, P, Q, S, V, or W
FKGNLDXL

SEQ ID NO: 1106 - protein, 8 aa, Artificial Sequence
  Description of Artificial Sequence: Synthetic Peptide
  SITE (7)..(7): Xaa is A, C, D, F, G, K, L, M, N, P, Q, R, or W
FKGNIRXI

SEQ ID NO: 1107 - protein, 8 aa, Artificial Sequence
  Description of Artificial Sequence: Synthetic Peptide
  SITE (7)..(7): Xaa is A, C, D, E, F, H, K, M, N, P, Q, R, S, T, W, or Y
FKGNLRXI

SEQ ID NO: 1108 - protein, 8 aa, Artificial Sequence
  Description of Artificial Sequence: Synthetic Peptide
  SITE (7)..(7): Xaa is A, C, F, G, H, K, L, M, N, P, W, or Y
FKGNIRXL

SEQ ID NO: 1109 - protein, 8 aa, Artificial Sequence
  Description of Artificial Sequence: Synthetic Peptide
  SITE (7)..(7): Xaa is A, C, F, G, H, I, K, L, M, P, Q, R, S, T, V, W, or Y
FKGNLRXL

SEQ ID NO: 1110 - protein, 8 aa, Artificial Sequence
  Description of Artificial Sequence: Synthetic Peptide
  SITE (7)..(7): Xaa is A, C, D, E, H, L, M, N, P, S, V, W, or Y
FKGNISXI

SEQ ID NO: 1111 - protein, 8 aa, Artificial Sequence
  Description of Artificial Sequence: Synthetic Peptide
  SITE (7)..(7): Xaa is C, D, F, I, K, M, P, Q, S, T, W, or Y
FKGNLSXI

SEQ ID NO: 1112 - protein, 8 aa, Artificial Sequence
  Description of Artificial Sequence: Synthetic Peptide
  SITE (7)..(7): Xaa is C, H, P, S, or W
FKGNISXL

SEQ ID NO: 1113 - protein, 8 aa, Artificial Sequence
  Description of Artificial Sequence: Synthetic Peptide
  SITE (7)..(7): Xaa is E, F, G, H, I, M, Q, S, T, or W
FKGNLSXL

SEQ ID NO: 1114 - protein, 8 aa, Artificial Sequence
  Description of Artificial Sequence: Synthetic Peptide
  SITE (7)..(7): Xaa is A, C, F, G, H, I, K, L, M, P, Q, R, T, W, or Y
FKGQIDXI

SEQ ID NO: 1115 - protein, 8 aa, Artificial Sequence
  Description of Artificial Sequence: Synthetic Peptide
  SITE (7)..(7): Xaa is A, C, D, E, F, H, I, K, L, N, Q, R, S, V, W, or Y
FKGQLDXI

SEQ ID NO: 1116 - protein, 8 aa, Artificial Sequence
  Description of Artificial Sequence: Synthetic Peptide
  SITE (7)..(7): Xaa is A, C, D, E, H, K, M, N, P, S, W, or Y
FKGQIDXL

SEQ ID NO: 1117 - protein, 8 aa, Artificial Sequence
  Description of Artificial Sequence: Synthetic Peptide
  SITE (7)..(7): Xaa is C, D, F, H, K, N, R, S, T, V, W, or Y
FKGQLDXL

SEQ ID NO: 1118 - protein, 8 aa, Artificial Sequence
  Description of Artificial Sequence: Synthetic Peptide
  SITE (7)..(7): Xaa is A, C, F, G, H, I, K, L, M, P, Q, R, T, W, or Y
FKGQIRXI

SEQ ID NO: 1119 - protein, 8 aa, Artificial Sequence
  Description of Artificial Sequence: Synthetic Peptide
  SITE (7)..(7): Xaa is A, D, E, F, I, K, M, N, P, R, T, W, or Y
FKGQLRXI

SEQ ID NO: 1120 - protein, 8 aa, Artificial Sequence
  Description of Artificial Sequence: Synthetic Peptide
  SITE (7)..(7): Xaa is A, C, D, E, F, G, H, I, K, M, P, Q, S, T, V, W, or Y
FKGQIRXL

SEQ ID NO: 1121 - protein, 8 aa, Artificial Sequence
  Description of Artificial Sequence: Synthetic Peptide
  SITE (7)..(7): Xaa is C, F, G, I, K, L, M, N, P, Q, R, S, T, V, W, or Y
FKGQLRXL

SEQ ID NO: 1122 - protein, 8 aa, Artificial Sequence
  Description of Artificial Sequence: Synthetic Peptide
  SITE (7)..(7): Xaa is A, C, D, E, F, H, I, K, M, P, Q, R, S, T, W, or Y
FKGQISXI

SEQ ID NO: 1123 - protein, 8 aa, Artificial Sequence
  Description of Artificial Sequence: Synthetic Peptide
  SITE (7)..(7): Xaa is A, C, E, F, G, H, I, L, N, P, T, V, W, or Y
FKGQLSXI

SEQ ID NO: 1124 - protein, 8 aa, Artificial Sequence
  Description of Artificial Sequence: Synthetic Peptide
  SITE (7)..(7): Xaa is A, C, D, E, G, H, I, K, L, M, N, P, Q, R, V, W, or Y
FKGQISXL

SEQ ID NO: 1125 - protein, 8 aa, Artificial Sequence
  Description of Artificial Sequence: Synthetic Peptide
  SITE (7)..(7): Xaa is C, G, H, K, L, M, N, P, R, or W
FKGQLSXL

SEQ ID NO: 1126 - protein, 8 aa, Artificial Sequence
  Description of Artificial Sequence: Synthetic Peptide
  SITE (7)..(7): Xaa is A, C, G, M, N, P, T, V, or W
FKGSIDXI

SEQ ID NO: 1127 - protein, 8 aa, Artificial Sequence
  Description of Artificial Sequence: Synthetic Peptide
  SITE (7)..(7): Xaa is A, G, H, M, N, P, R, S, T, V, or W
FKGSLDXI

SEQ ID NO: 1128 - protein, 8 aa, Artificial Sequence
  Description of Artificial Sequence: Synthetic Peptide
  SITE (7)..(7): Xaa is C, G, H, L, M, N, P, Q, R, S, T, V, or W
FKGSIDXL

SEQ ID NO: 1129 - protein, 8 aa, Artificial Sequence
  Description of Artificial Sequence: Synthetic Peptide
  SITE (7)..(7): Xaa is C, H, M, N, Q, T, or W
FKGSLDXL

SEQ ID NO: 1130 - protein, 8 aa, Artificial Sequence
  Description of Artificial Sequence: Synthetic Peptide
  SITE (7)..(7): Xaa is A, C, E, F, G, H, I, K, L, N, Q, R, S, T, V, W, or Y
FKGSIRXI

SEQ ID NO: 1131 - protein, 8 aa, Artificial Sequence
  Description of Artificial Sequence: Synthetic Peptide
  SITE (7)..(7): Xaa is A, C, D, F, H, K, L, M, N, P, R, V, W, or Y
FKGSLRXI

SEQ ID NO: 1132 - protein, 8 aa, Artificial Sequence
  Description of Artificial Sequence: Synthetic Peptide
  SITE (7)..(7): Xaa is A, D, E, F, G, H, K, L, M, N, P, Q, R, T, V, W, or Y
FKGSIRXL

SEQ ID NO: 1133 - protein, 8 aa, Artificial Sequence
  Description of Artificial Sequence: Synthetic Peptide
  SITE (7)..(7): Xaa is E, F, I, L, M, N, P, Q, T, or W
FKGSLRXL

SEQ ID NO: 1134 - protein, 8 aa, Artificial Sequence
  Description of Artificial Sequence: Synthetic Peptide
  SITE (7)..(7): Xaa is A, C, G, M, N, P, T, V, or W
FKGSISXI

SEQ ID NO: 1135 - protein, 8 aa, Artificial Sequence
  Description of Artificial Sequence: Synthetic Peptide
  SITE (7)..(7): Xaa is C, D, H, I, K, L, P, Q, R, or W
FKGSLSXI

SEQ ID NO: 1136 - protein, 8 aa, Artificial Sequence
  Description of Artificial Sequence: Synthetic Peptide
  SITE (7)..(7): Xaa is A, D, F, G, H, K, L, M, N, P, Q, R, T, V, W, or Y
FKGSISXL

SEQ ID NO: 1137 - protein, 8 aa, Artificial Sequence
  Description of Artificial Sequence: Synthetic Peptide
  SITE (7)..(7): Xaa is C, H, V, W, or Y
FKGSLSXL

SEQ ID NO: 1138 - protein, 8 aa, Artificial Sequence
  Description of Artificial Sequence: Synthetic Peptide
  SITE (7)..(7): Xaa is A, C, H, L, M, N, P, Q, R, S, V, or W
FKLDIDXI

SEQ ID NO: 1139 - protein, 8 aa, Artificial Sequence
  Description of Artificial Sequence: Synthetic Peptide
  SITE (7)..(7): Xaa is A, C, D, F, G, H, I, M, N, P, Q, R, T, V, W, or Y
FKLDLDXI

SEQ ID NO: 1140 - protein, 8 aa, Artificial Sequence
  Description of Artificial Sequence: Synthetic Peptide
  SITE (7)..(7): Xaa is A, C, F, H, I, L, M, P, Q, T, V, or W
FKLDIDXL

SEQ ID NO: 1141 - protein, 8 aa, Artificial Sequence
  Description of Artificial Sequence: Synthetic Peptide
  SITE (7)..(7): Xaa is D, F, G, M, P, T, W, or Y
FKLDLDXL

SEQ ID NO: 1142 - protein, 8 aa, Artificial Sequence
  Description of Artificial Sequence: Synthetic Peptide
  SITE (7)..(7): Xaa is A, D, C, F, G, H, I, K, L, M, P, Q, R, S, T, V, or Y
FKLDIRXI

SEQ ID NO: 1143 - protein, 8 aa, Artificial Sequence
  Description of Artificial Sequence: Synthetic Peptide
  SITE (7)..(7): Xaa is C, D, G, H, L, M, N, P, Q, S, T, V, W, or Y
FKLDLRXI

SEQ ID NO: 1144 - protein, 8 aa, Artificial Sequence
  Description of Artificial Sequence: Synthetic Peptide
  SITE (7)..(7): Xaa is C, E, G, H, I, L, M, P, Q, R, S, T, V, W, or Y
FKLDIRXL

SEQ ID NO: 1145 - protein, 8 aa, Artificial Sequence
  Description of Artificial Sequence: Synthetic Peptide
  SITE (7)..(7): Xaa is C, D, F, G, K, L, Q, R, V, W, or Y
FKLDLRXL

SEQ ID NO: 1146 - protein, 8 aa, Artificial Sequence
  Description of Artificial Sequence: Synthetic Peptide
  SITE (7)..(7): Xaa is C, E, F, G, H, I, M, Q, R, S, V, W, or Y
FKLDISXI

SEQ ID NO: 1147 - protein, 8 aa, Artificial Sequence
  Description of Artificial Sequence: Synthetic Peptide
  SITE (7)..(7): Xaa is C, F, H, N , or W
FKLDLSXI

SEQ ID NO: 1148 - protein, 8 aa, Artificial Sequence
  Description of Artificial Sequence: Synthetic Peptide
  SITE (7)..(7): Xaa is C, D, F, G, M, N, P, R, W, or Y
FKLDISXL

SEQ ID NO: 1149 - protein, 8 aa, Artificial Sequence
  Description of Artificial Sequence: Synthetic Peptide
  SITE (7)..(7): Xaa is C, E, L, or M
FKLDLSXL

SEQ ID NO: 1150 - protein, 8 aa, Artificial Sequence
  Description of Artificial Sequence: Synthetic Peptide
  SITE (7)..(7): Xaa is C, D, E, F, G, H, L, M, P, R, T, or V
FKLEIDXI

SEQ ID NO: 1151 - protein, 8 aa, Artificial Sequence
  Description of Artificial Sequence: Synthetic Peptide
  SITE (7)..(7): Xaa is A, C, E, F, H, L, M, N, P, T, V, W, or Y
FKLELDXI

SEQ ID NO: 1152 - protein, 8 aa, Artificial Sequence
  Description of Artificial Sequence: Synthetic Peptide
  SITE (7)..(7): Xaa is A, C, H, I, K, L, M, N, Q, T, V, W, or Y
FKLEIDXL

SEQ ID NO: 1153 - protein, 8 aa, Artificial Sequence
  Description of Artificial Sequence: Synthetic Peptide
  SITE (7)..(7): Xaa is A, C, E, G, I, L, Q, S, V, or W
FKLELDXL

SEQ ID NO: 1154 - protein, 8 aa, Artificial Sequence
  Description of Artificial Sequence: Synthetic Peptide
  SITE (7)..(7): Xaa is A, C, E, G, H, I, M, N, P, Q, R, S, V, W, or Y
FKLEIRXI

SEQ ID NO: 1155 - protein, 8 aa, Artificial Sequence
  Description of Artificial Sequence: Synthetic Peptide
  SITE (7)..(7): Xaa is A, C, D, E, F, G, H, I, K, L, M, N, P, Q, R, S, T, V, W, or Y
FKLELRXI

SEQ ID NO: 1156 - protein, 8 aa, Artificial Sequence
  Description of Artificial Sequence: Synthetic Peptide
  SITE (7)..(7): Xaa is C, E, F, H, I, K, L, M, N, P, Q, R, S, V, or W
FKLEIRXL

SEQ ID NO: 1157 - protein, 8 aa, Artificial Sequence
  Description of Artificial Sequence: Synthetic Peptide
  SITE (7)..(7): Xaa is A, C, D, E, F, G, H, L, M, N, P, Q, V, W, or Y
FKLELRXL

SEQ ID NO: 1158 - protein, 8 aa, Artificial Sequence
  Description of Artificial Sequence: Synthetic Peptide
  SITE (7)..(7): Xaa is A, F, G, M, V, W, or Y
FKLEISXI

SEQ ID NO: 1159 - protein, 8 aa, Artificial Sequence
  Description of Artificial Sequence: Synthetic Peptide
  SITE (7)..(7): Xaa is F, H, I, M, N, R, S, W, or Y
FKLELSXI

SEQ ID NO: 1160 - protein, 8 aa, Artificial Sequence
  Description of Artificial Sequence: Synthetic Peptide
  SITE (7)..(7): Xaa is A, C, F, H, I, M, N, Q, R, V, W, or Y
FKLEISXL

SEQ ID NO: 1161 - protein, 8 aa, Artificial Sequence
  Description of Artificial Sequence: Synthetic Peptide
  SITE (7)..(7): Xaa is I, K, M, N, or Y
FKLELSXL

SEQ ID NO: 1162 - protein, 8 aa, Artificial Sequence
  Description of Artificial Sequence: Synthetic Peptide
  SITE (7)..(7): Xaa is C, D, E, F, G, H, K, L, Q, T, V, W, or Y
FKLNIDXI

SEQ ID NO: 1163 - protein, 8 aa, Artificial Sequence
  Description of Artificial Sequence: Synthetic Peptide
  SITE (7)..(7): Xaa is A, E, G, H, L, M, N, P, Q, R, S, T, V, W, or Y
FKLNLDXI

SEQ ID NO: 1164 - protein, 8 aa, Artificial Sequence
  Description of Artificial Sequence: Synthetic Peptide
  SITE (7)..(7): Xaa is A, C, H, I, M, N, P, R, S, T, V, W, or Y
FKLNIDXL

SEQ ID NO: 1165 - protein, 8 aa, Artificial Sequence
  Description of Artificial Sequence: Synthetic Peptide
  SITE (7)..(7): Xaa is A, C, D, E, G, H, M, N, P, R, W or Y
FKLNLDXL

SEQ ID NO: 1166 - protein, 8 aa, Artificial Sequence
  Description of Artificial Sequence: Synthetic Peptide
  SITE (7)..(7): Xaa is A, C, D, E, F, G, H, I, K, L, M, S, T, V, W, or Y
FKLNIRXI

SEQ ID NO: 1167 - protein, 8 aa, Artificial Sequence
  Description of Artificial Sequence: Synthetic Peptide
  SITE (7)..(7): Xaa is A, C, E, F, G, H, K, L, M, Q, S, T, V, W, or Y
FKLNLRXI

SEQ ID NO: 1168 - protein, 8 aa, Artificial Sequence
  Description of Artificial Sequence: Synthetic Peptide
  SITE (7)..(7): Xaa is C, E, F, G, H, K, M, N, P, Q, R, S, T, V, W, or Y
FKLNIRXL

SEQ ID NO: 1169 - protein, 8 aa, Artificial Sequence
  Description of Artificial Sequence: Synthetic Peptide
  SITE (7)..(7): Xaa is A, C, D, E, F, G, I, L, Q, R, S, T, W, or Y
FKLNLRXL

SEQ ID NO: 1170 - protein, 8 aa, Artificial Sequence
  Description of Artificial Sequence: Synthetic Peptide
  SITE (7)..(7): Xaa is A, C, F ,H, I, M, R, S, T, W, or Y
FKLNISXI

SEQ ID NO: 1171 - protein, 8 aa, Artificial Sequence
  Description of Artificial Sequence: Synthetic Peptide
  SITE (7)..(7): Xaa is A, C, D, F, I, M, R, T, V ,W, or Y
FKLNLSXI

SEQ ID NO: 1172 - protein, 8 aa, Artificial Sequence
  Description of Artificial Sequence: Synthetic Peptide
  SITE (7)..(7): Xaa is A, C, D, E, F, H, K, M, R, S, or W
FKLNISXL

SEQ ID NO: 1173 - protein, 8 aa, Artificial Sequence
  Description of Artificial Sequence: Synthetic Peptide
  SITE (7)..(7): Xaa is A, C, D, H, L, N, P, R, V, W, or Y
FKLNLSXL

SEQ ID NO: 1174 - protein, 8 aa, Artificial Sequence
  Description of Artificial Sequence: Synthetic Peptide
  SITE (7)..(7): Xaa is A, C, E, F, G, H, I, K, L, M, N, P, Q, R, S, T, V, W, or Y
FKLQIDXI

SEQ ID NO: 1175 - protein, 8 aa, Artificial Sequence
  Description of Artificial Sequence: Synthetic Peptide
  SITE (7)..(7): Xaa is A, C, D, E, F, H, K, M, N, P, Q, R, S, T, V, W, or Y
FKLQLDXI

SEQ ID NO: 1176 - protein, 8 aa, Artificial Sequence
  Description of Artificial Sequence: Synthetic Peptide
  SITE (7)..(7): Xaa is C, D, F, H, I, L, N, P, R, T, V, W, or Y
FKLQIDXL

SEQ ID NO: 1177 - protein, 8 aa, Artificial Sequence
  Description of Artificial Sequence: Synthetic Peptide
  SITE (7)..(7): Xaa is A, C, D, G, H, I, K, M, P, Q, S, V, W, or Y
FKLQLDXL

SEQ ID NO: 1178 - protein, 8 aa, Artificial Sequence
  Description of Artificial Sequence: Synthetic Peptide
  SITE (7)..(7): Xaa is C, D, E, F, G, H, I, K, L, M, P, Q, R, S, T, V, W, or Y
FKLQIRXI

SEQ ID NO: 1179 - protein, 8 aa, Artificial Sequence
  Description of Artificial Sequence: Synthetic Peptide
  SITE (7)..(7): Xaa is A, C, D, E, F, G, H, I, K, L, M, N, P, Q, R, T, V, W, or Y
FKLQLRXI

SEQ ID NO: 1180 - protein, 8 aa, Artificial Sequence
  Description of Artificial Sequence: Synthetic Peptide
  SITE (7)..(7): Xaa is A, C, D, E, F, G, H, I, L, M, N, P, Q, S, T, V, W, or Y
FKLQIRXL

SEQ ID NO: 1181 - protein, 8 aa, Artificial Sequence
  Description of Artificial Sequence: Synthetic Peptide
  SITE (7)..(7): Xaa is C, F, G ,H ,I ,L, M, N, Q, R, S, V, W, or Y
FKLQLRXL

SEQ ID NO: 1182 - protein, 8 aa, Artificial Sequence
  Description of Artificial Sequence: Synthetic Peptide
  SITE (7)..(7): Xaa is C, D, E, G, H, I, K, L, M, N, P, Q, R, S, T, V, or W
FKLQISXI

SEQ ID NO: 1183 - protein, 8 aa, Artificial Sequence
  Description of Artificial Sequence: Synthetic Peptide
  SITE (7)..(7): Xaa is C, E, G, H, K, N, P, Q, R, S, T, V, W, or Y
FKLQLSXI

SEQ ID NO: 1184 - protein, 8 aa, Artificial Sequence
  Description of Artificial Sequence: Synthetic Peptide
  SITE (7)..(7): Xaa is A, C, E, G, H, K, L, M, P, Q, R, S, T, V, W, or Y
FKLQISXL

SEQ ID NO: 1185 - protein, 8 aa, Artificial Sequence
  Description of Artificial Sequence: Synthetic Peptide
  SITE (7)..(7): Xaa is A, C, D, E, F, G, H, K, M, N, P, R, or T
FKLQLSXL

SEQ ID NO: 1186 - protein, 8 aa, Artificial Sequence
  Description of Artificial Sequence: Synthetic Peptide
  SITE (7)..(7): Xaa is A, C, F, H, I, L, S, T, V, W, or Y
FKLSIDXI

SEQ ID NO: 1187 - protein, 8 aa, Artificial Sequence
  Description of Artificial Sequence: Synthetic Peptide
  SITE (7)..(7): Xaa is C, F, G, I, L, M, N, R, S, T, W, or Y
FKLSLDXI

SEQ ID NO: 1188 - protein, 8 aa, Artificial Sequence
  Description of Artificial Sequence: Synthetic Peptide
  SITE (7)..(7): Xaa is A, C, E, H, M, N, P, R, S, T, V, W, or Y
FKLSIDXL

SEQ ID NO: 1189 - protein, 8 aa, Artificial Sequence
  Description of Artificial Sequence: Synthetic Peptide
  SITE (7)..(7): Xaa is C, D, F, G, I, K, M, V, W, or Y
FKLSLDXL

SEQ ID NO: 1190 - protein, 8 aa, Artificial Sequence
  Description of Artificial Sequence: Synthetic Peptide
  SITE (7)..(7): Xaa is A, C, D, E, F, G, H, I, L, M, N, P, Q, S, T, V, W, or Y
FKLSIRXI

SEQ ID NO: 1191 - protein, 8 aa, Artificial Sequence
  Description of Artificial Sequence: Synthetic Peptide
  SITE (7)..(7): Xaa is C, E, F, G, H, I, K, L, M, Q, R, S, T, V, or W
FKLSLRXI

SEQ ID NO: 1192 - protein, 8 aa, Artificial Sequence
  Description of Artificial Sequence: Synthetic Peptide
  SITE (7)..(7): Xaa is C, M, R, or V
FKLSIRXL

SEQ ID NO: 1193 - protein, 8 aa, Artificial Sequence
  Description of Artificial Sequence: Synthetic Peptide
  SITE (7)..(7): Xaa is C, I, K, M, N, P, R, V, or W
FKLSLRXL

SEQ ID NO: 1194 - protein, 8 aa, Artificial Sequence
  Description of Artificial Sequence: Synthetic Peptide
  SITE (7)..(7): Xaa is C, F, G, H, M, R, S, T, or W
FKLSISXI

SEQ ID NO: 1195 - protein, 8 aa, Artificial Sequence
  Description of Artificial Sequence: Synthetic Peptide
  SITE (7)..(7): Xaa is C, E, F, H, L, Q, R, or W
FKLSLSXI

SEQ ID NO: 1196 - protein, 8 aa, Artificial Sequence
  Description of Artificial Sequence: Synthetic Peptide
  SITE (7)..(7): Xaa is C, E, H, I, N, V, W, or Y
FKLSISXL

SEQ ID NO: 1197 - protein, 8 aa, Artificial Sequence
  Description of Artificial Sequence: Synthetic Peptide
  SITE (7)..(7): Xaa is C, F, H, M, N, Q, V, or W
FKLSLSXL

SEQ ID NO: 1198 - protein, 8 aa, Artificial Sequence
  Description of Artificial Sequence: Synthetic Peptide
  SITE (7)..(7): Xaa is A, C, E, F, G, H, I, K, M, R, S, W, or Y
FKNDIDXI

SEQ ID NO: 1199 - protein, 8 aa, Artificial Sequence
  Description of Artificial Sequence: Synthetic Peptide
  SITE (7)..(7): Xaa is A, C, F, G, H, I, M, N, P, Q, R, S, T, V, W, or Y
FKNDLDXI

SEQ ID NO: 1200 - protein, 8 aa, Artificial Sequence
  Description of Artificial Sequence: Synthetic Peptide
  SITE (7)..(7): Xaa is C, F, H, K, M, S, W, or Y
FKNDIDXL

SEQ ID NO: 1201 - protein, 7 aa, Artificial Sequence
  Description of Artificial Sequence: Synthetic Peptide
  SITE (7)..(7): Xaa is C, F, L, M, W, or Y
FKNDLDL

SEQ ID NO: 1202 - protein, 8 aa, Artificial Sequence
  Description of Artificial Sequence: Synthetic Peptide
  SITE (7)..(7): Xaa is A, C, E, G, H, K, M, N, P, Q, R, S, T, W, or Y
FKNDIRXI

SEQ ID NO: 1203 - protein, 8 aa, Artificial Sequence
  Description of Artificial Sequence: Synthetic Peptide
  SITE (7)..(7): Xaa is A, C, D, E, F, G, H, I,K, L, N, Q, R, S, V, W, or Y
FKNDLRXI

SEQ ID NO: 1204 - protein, 8 aa, Artificial Sequence
  Description of Artificial Sequence: Synthetic Peptide
  SITE (7)..(7): Xaa is A, C, D, F, G, H, K, L, M, N, P, Q, R, S, T, W, or Y
FKNDIRDL

SEQ ID NO: 1205 - protein, 8 aa, Artificial Sequence
  Description of Artificial Sequence: Synthetic Peptide
  SITE (7)..(7): Xaa is C, D, F, H, K, M, N, Q, R, S, T, W, or Y
FKNDLRXL

SEQ ID NO: 1206 - protein, 8 aa, Artificial Sequence
  Description of Artificial Sequence: Synthetic Peptide
  SITE (7)..(7): Xaa is A, C, F, I, K, M, N, Q, R, S, T, V, W, or Y
FKNDISXI

SEQ ID NO: 1207 - protein, 8 aa, Artificial Sequence
  Description of Artificial Sequence: Synthetic Peptide
  SITE (7)..(7): Xaa is A, C, D, E, G, H, L, N, P, R, W, or Y
FKNDLSXI

SEQ ID NO: 1208 - protein, 8 aa, Artificial Sequence
  Description of Artificial Sequence: Synthetic Peptide
  SITE (7)..(7): Xaa is A, C, D, F, G, I, L, M, N, P, R, T, V, W, or Y
FKNDISXL

SEQ ID NO: 1209 - protein, 8 aa, Artificial Sequence
  Description of Artificial Sequence: Synthetic Peptide
  SITE (7)..(7): Xaa is C, E ,H ,I, K, M, N, T, V, W, or Y
FKNDLSXL

SEQ ID NO: 1210 - protein, 8 aa, Artificial Sequence
  Description of Artificial Sequence: Synthetic Peptide
  SITE (7)..(7): Xaa is C, D, F, G, H, M, Q, T, W, or Y
FKNEIDXI

SEQ ID NO: 1211 - protein, 8 aa, Artificial Sequence
  Description of Artificial Sequence: Synthetic Peptide
  SITE (7)..(7): Xaa is A, G, H, I, K, L, P, Q, S, T, V, or W
FKNELDXI

SEQ ID NO: 1212 - protein, 8 aa, Artificial Sequence
  Description of Artificial Sequence: Synthetic Peptide
  SITE (7)..(7): Xaa is C, E, G, M, P, Q, S ,W, or Y
FKNEIDXL

SEQ ID NO: 1213 - protein, 8 aa, Artificial Sequence
  Description of Artificial Sequence: Synthetic Peptide
  SITE (7)..(7): Xaa is C, F, H, I, M, P, R, W, or Y
FKNELDXL

SEQ ID NO: 1214 - protein, 8 aa, Artificial Sequence
  Description of Artificial Sequence: Synthetic Peptide
  SITE (7)..(7): Xaa is A, C, D, F, G, H, K, M, N, P, Q, T, V, or W
FKNELRXI

SEQ ID NO: 1215 - protein, 8 aa, Artificial Sequence
  Description of Artificial Sequence: Synthetic Peptide
  SITE (7)..(7): Xaa is A, C, D, F, G, H, I, K, M, P, S, T, V, W, or Y
FKNEIRXL

SEQ ID NO: 1216 - protein, 8 aa, Artificial Sequence
  Description of Artificial Sequence: Synthetic Peptide
  SITE (7)..(7): Xaa is C, D, G, H, M, P, Q, S, W, or Y
FKNELRXL

SEQ ID NO: 1217 - protein, 8 aa, Artificial Sequence
  Description of Artificial Sequence: Synthetic Peptide
  SITE (7)..(7): Xaa is C, D, F, G, H, I, L, M, N, Q, R, W, or Y
FKNEISXI

SEQ ID NO: 1218 - protein, 8 aa, Artificial Sequence
  Description of Artificial Sequence: Synthetic Peptide
  SITE (7)..(7): Xaa is A, C, G, H, M, N, P, Q, R, T, W, or Y
FKNELSXI

SEQ ID NO: 1219 - protein, 8 aa, Artificial Sequence
  Description of Artificial Sequence: Synthetic Peptide
  SITE (7)..(7): Xaa is A, C, F ,M, W, or Y
FKNEISXL

SEQ ID NO: 1220 - protein, 8 aa, Artificial Sequence
  Description of Artificial Sequence: Synthetic Peptide
  SITE (7)..(7): Xaa is F, G, H, R, W, or Y
FKNELSXL

SEQ ID NO: 1221 - protein, 8 aa, Artificial Sequence
  Description of Artificial Sequence: Synthetic Peptide
  SITE (7)..(7): Xaa is A, C, G, H, N, P, R, or W
FKNNIDXI

SEQ ID NO: 1222 - protein, 8 aa, Artificial Sequence
  Description of Artificial Sequence: Synthetic Peptide
  SITE (7)..(7): Xaa is C, D, E, F, G, N, P, S, T, V, or W
FKNNLDXI

SEQ ID NO: 1223 - protein, 8 aa, Artificial Sequence
  Description of Artificial Sequence: Synthetic Peptide
  SITE (7)..(7): Xaa is C, D, G, H, I, M, P, Q, R, T, W, or Y
FKNNIDXL

SEQ ID NO: 1224 - protein, 8 aa, Artificial Sequence
  Description of Artificial Sequence: Synthetic Peptide
  SITE (7)..(7): Xaa is C, D, E, F, G, H, I, L, M, R, or W
FKNNLDXL

SEQ ID NO: 1225 - protein, 8 aa, Artificial Sequence
  Description of Artificial Sequence: Synthetic Peptide
  SITE (7)..(7): Xaa is C, E, G, H, I, L, M, Q, T, or W
FKNNIRXI

SEQ ID NO: 1226 - protein, 8 aa, Artificial Sequence
  Description of Artificial Sequence: Synthetic Peptide
  SITE (7)..(7): Xaa is A, C, E, H, L, N, S, T, V, or W
FKNNLRXI

SEQ ID NO: 1227 - protein, 8 aa, Artificial Sequence
  Description of Artificial Sequence: Synthetic Peptide
  SITE (7)..(7): Xaa is C, D, F, G, I, K, M, P, Q, R, S, T, W, or Y
FKNNIRXL

SEQ ID NO: 1228 - protein, 8 aa, Artificial Sequence
  Description of Artificial Sequence: Synthetic Peptide
  SITE (7)..(7): Xaa is C, F, G, H, K, M, P, Q, R, V, W, or Y
FKNNLRXL

SEQ ID NO: 1229 - protein, 8 aa, Artificial Sequence
  Description of Artificial Sequence: Synthetic Peptide
  SITE (7)..(7): Xaa is A, D, I, M, Q, S, or W
FKNNISXI

SEQ ID NO: 1230 - protein, 8 aa, Artificial Sequence
  Description of Artificial Sequence: Synthetic Peptide
  SITE (7)..(7): Xaa is A, C, F, G, I, M, P, R, V, W, or Y
FKNNLSXI

SEQ ID NO: 1231 - protein, 8 aa, Artificial Sequence
  Description of Artificial Sequence: Synthetic Peptide
  SITE (7)..(7): Xaa is C, F, G, H, M, P, Q, S, T, or W
FKNNISXL

SEQ ID NO: 1232 - protein, 8 aa, Artificial Sequence
  Description of Artificial Sequence: Synthetic Peptide
  SITE (7)..(7): Xaa is C, F, G, H, L, M, P, T, W, or Y
FKNNLSXL

SEQ ID NO: 1233 - protein, 8 aa, Artificial Sequence
  Description of Artificial Sequence: Synthetic Peptide
  SITE (7)..(7): Xaa is A, C, D, E, G, H, I, L, M, N, P, Q, R, S, V, or Y
FKNQIDXI

SEQ ID NO: 1234 - protein, 8 aa, Artificial Sequence
  Description of Artificial Sequence: Synthetic Peptide
  SITE (7)..(7): Xaa is C, E, F, G, I, L, N, P, Q, or Y
FKNQLDXI

SEQ ID NO: 1235 - protein, 8 aa, Artificial Sequence
  Description of Artificial Sequence: Synthetic Peptide
  SITE (7)..(7): Xaa is C, F, G, H, K, N, P, R, S, or T
FKNQIDXL

SEQ ID NO: 1236 - protein, 8 aa, Artificial Sequence
  Description of Artificial Sequence: Synthetic Peptide
  SITE (7)..(7): Xaa is C, D, F, G, I, M, N, P, V, W, or Y
FKNQLDXL

SEQ ID NO: 1237 - protein, 8 aa, Artificial Sequence
  Description of Artificial Sequence: Synthetic Peptide
  SITE (7)..(7): Xaa is C, D, F, G, H, I, L, M, N, P, Q, R, S, T, V, W, or Y
FKNQIRXI

SEQ ID NO: 1238 - protein, 8 aa, Artificial Sequence
  Description of Artificial Sequence: Synthetic Peptide
  SITE (7)..(7): Xaa is A, C, D, E, F, G, H, K, M, P, R, T, V, W, or Y
FKNQLRXI

SEQ ID NO: 1239 - protein, 8 aa, Artificial Sequence
  Description of Artificial Sequence: Synthetic Peptide
  SITE (7)..(7): Xaa is C, D, F, G, H, I, M, N, P, Q, R, S, T, V ,W, or Y
FKNQIRXL

SEQ ID NO: 1240 - protein, 8 aa, Artificial Sequence
  Description of Artificial Sequence: Synthetic Peptide
  SITE (7)..(7): Xaa is C, F, G, H, I, K, L, M, P, R, S, W, or Y
FKNQLRXL

SEQ ID NO: 1241 - protein, 8 aa, Artificial Sequence
  Description of Artificial Sequence: Synthetic Peptide
  SITE (7)..(7): Xaa is A, C, F, G, H, I, L, M, N, P, Q, R, S, T, V, W, or Y
FKNQISXI

SEQ ID NO: 1242 - protein, 8 aa, Artificial Sequence
  Description of Artificial Sequence: Synthetic Peptide
  SITE (7)..(7): Xaa is A, E, F, G, K, L, N, P, Q, S, T, V, W, or Y
FKNQLSXI

SEQ ID NO: 1243 - protein, 8 aa, Artificial Sequence
  Description of Artificial Sequence: Synthetic Peptide
  SITE (7)..(7): Xaa is C, E, F, G, H, I, M, T, V, or Y
FKNQISXL

SEQ ID NO: 1244 - protein, 8 aa, Artificial Sequence
  Description of Artificial Sequence: Synthetic Peptide
  SITE (7)..(7): Xaa is A, M, P, R, or W
FKNQLSXL

SEQ ID NO: 1245 - protein, 8 aa, Artificial Sequence
  Description of Artificial Sequence: Synthetic Peptide
  SITE (7)..(7): Xaa is C, D, E, G, H, I, K, M, Q, R, S, T, or W
FKNSIDXI

SEQ ID NO: 1246 - protein, 8 aa, Artificial Sequence
  Description of Artificial Sequence: Synthetic Peptide
  SITE (7)..(7): Xaa is C, D, H, I, M, Q, R, or W
FKNSLDXI

SEQ ID NO: 1247 - protein, 8 aa, Artificial Sequence
  Description of Artificial Sequence: Synthetic Peptide
  SITE (7)..(7): Xaa is A, H, I, L, M, P, T, V, W, or Y
FKNSIDXL

SEQ ID NO: 1248 - protein, 8 aa, Artificial Sequence
  Description of Artificial Sequence: Synthetic Peptide
  SITE (7)..(7): Xaa is C, F, I, P, Q, R, or T
FKNSLDXL

SEQ ID NO: 1249 - protein, 8 aa, Artificial Sequence
  Description of Artificial Sequence: Synthetic Peptide
  SITE (7)..(7): Xaa is A, C, D, G, H, K, M, P, V, W, or Y
FKNSIRXI

SEQ ID NO: 1250 - protein, 8 aa, Artificial Sequence
  Description of Artificial Sequence: Synthetic Peptide
  SITE (7)..(7): Xaa is A, C, D, E, F, G, H, L, M, N, Q, R, T, V ,W, or Y
FKNSLRXI

SEQ ID NO: 1251 - protein, 8 aa, Artificial Sequence
  Description of Artificial Sequence: Synthetic Peptide
  SITE (7)..(7): Xaa is A, C, E, F, G, H, K, P, R, T, V, W, or Y
FKNSIRXL

SEQ ID NO: 1252 - protein, 8 aa, Artificial Sequence
  Description of Artificial Sequence: Synthetic Peptide
  SITE (7)..(7): Xaa is D, E, F, H, K, L, M, N, P, or W
FKNSLRXL

SEQ ID NO: 1253 - protein, 8 aa, Artificial Sequence
  Description of Artificial Sequence: Synthetic Peptide
  SITE (7)..(7): Xaa is C, F, G, H, L, M, P, R, V, W, or Y
FKNSISXI

SEQ ID NO: 1254 - protein, 8 aa, Artificial Sequence
  Description of Artificial Sequence: Synthetic Peptide
  SITE (7)..(7): Xaa is C, L, M, N, R, V, W, or Y
FKNSLSXI

SEQ ID NO: 1255 - protein, 8 aa, Artificial Sequence
  Description of Artificial Sequence: Synthetic Peptide
  SITE (7)..(7): Xaa is E, F, I, L, or W
FKNSISXL

SEQ ID NO: 1256 - protein, 8 aa, Artificial Sequence
  Description of Artificial Sequence: Synthetic Peptide
  SITE (7)..(7): Xaa is A, C, F, H, L, T, V, or Y
FKNSLSXL

SEQ ID NO: 1257 - protein, 8 aa, Artificial Sequence
  Description of Artificial Sequence: Synthetic Peptide
  SITE (7)..(7): Xaa is C, E, F, H, M, N, P, S, T, V, or W
FKSDIDXI

SEQ ID NO: 1258 - protein, 8 aa, Artificial Sequence
  Description of Artificial Sequence: Synthetic Peptide
  SITE (7)..(7): Xaa is A, C, D, E, F, G, H, I, M, P, S, T, V, W, or Y
FKSDLDXI

SEQ ID NO: 1259 - protein, 8 aa, Artificial Sequence
  Description of Artificial Sequence: Synthetic Peptide
  SITE (7)..(7): Xaa is A, I, K, L, M, W, or Y
FKSDIDXL

SEQ ID NO: 1260 - protein, 8 aa, Artificial Sequence
  Description of Artificial Sequence: Synthetic Peptide
  SITE (7)..(7): Xaa is C, E, F, G, K, L, M, N, Q, S, T, V, W, or Y
FKSDLDXL

SEQ ID NO: 1261 - protein, 8 aa, Artificial Sequence
  Description of Artificial Sequence: Synthetic Peptide
  SITE (7)..(7): Xaa is A, C, F, G, I, L, M, P, Q, R, S, T, V, W, or Y
FKSDIRXI

SEQ ID NO: 1262 - protein, 8 aa, Artificial Sequence
  Description of Artificial Sequence: Synthetic Peptide
  SITE (7)..(7): Xaa is C, D, G, H, I, K, L, M, N, P, Q, T, V, W, or Y
FKSDLRXI

SEQ ID NO: 1263 - protein, 8 aa, Artificial Sequence
  Description of Artificial Sequence: Synthetic Peptide
  SITE (7)..(7): Xaa is C, F, H, I, K, M, N, P, Q, S, V, W, or Y
FKSDIRXL

SEQ ID NO: 1264 - protein, 8 aa, Artificial Sequence
  Description of Artificial Sequence: Synthetic Peptide
  SITE (7)..(7): Xaa is A, C, D, E, F, G, H, I, K, M, P, Q, R, S, W, or Y
FKSDLRXL

SEQ ID NO: 1265 - protein, 8 aa, Artificial Sequence
  Description of Artificial Sequence: Synthetic Peptide
  SITE (7)..(7): Xaa is C, E, G, H, I, N, P, Q, R, T, V, W, or Y
FKSDISXI

SEQ ID NO: 1266 - protein, 8 aa, Artificial Sequence
  Description of Artificial Sequence: Synthetic Peptide
  SITE (7)..(7): Xaa is A, C, D, F, G, H, K, L, M, P, Q, V, W, or Y
FKSDLSXI

SEQ ID NO: 1267 - protein, 8 aa, Artificial Sequence
  Description of Artificial Sequence: Synthetic Peptide
  SITE (7)..(7): Xaa is A, C, D, E, F, H, K, L, N, P, Q, T, or W
FKSDISXL

SEQ ID NO: 1268 - protein, 8 aa, Artificial Sequence
  Description of Artificial Sequence: Synthetic Peptide
  SITE (7)..(7): Xaa is C, E, F, H, I, M, P, Q, R, T, W, or Y
FKSDLSXL

SEQ ID NO: 1269 - protein, 8 aa, Artificial Sequence
  Description of Artificial Sequence: Synthetic Peptide
  SITE (7)..(7): Xaa is C, D, E, F, H, I, K, M, N, P, R, S, V, or Y
FKSEIDXI

SEQ ID NO: 1270 - protein, 8 aa, Artificial Sequence
  Description of Artificial Sequence: Synthetic Peptide
  SITE (7)..(7): Xaa is C, H, M, V, W, or Y
FKSELDXI

SEQ ID NO: 1271 - protein, 8 aa, Artificial Sequence
  Description of Artificial Sequence: Synthetic Peptide
  SITE (7)..(7): Xaa is A, C, L, M, P, or W
FKSEIDXL

SEQ ID NO: 1272 - protein, 8 aa, Artificial Sequence
  Description of Artificial Sequence: Synthetic Peptide
  SITE (7)..(7): Xaa is C, D, M, P, Q, W, or Y
FKSELDXL

SEQ ID NO: 1273 - protein, 8 aa, Artificial Sequence
  Description of Artificial Sequence: Synthetic Peptide
  SITE (7)..(7): Xaa is A, C, D, E, F, H, I, K, L, M, N, P, Q, R, T, W, or Y
FKSEIRXI

SEQ ID NO: 1274 - protein, 8 aa, Artificial Sequence
  Description of Artificial Sequence: Synthetic Peptide
  SITE (7)..(7): Xaa is A, C, F, G, H, I, K, L, M, R, S, V, W, or Y
FKSELRXI

SEQ ID NO: 1275 - protein, 8 aa, Artificial Sequence
  Description of Artificial Sequence: Synthetic Peptide
  SITE (7)..(7): Xaa is C, D, F, G, H, I, K, M, P, Q, R, T, V, W, or Y
FKSEIRXL

SEQ ID NO: 1276 - protein, 8 aa, Artificial Sequence
  Description of Artificial Sequence: Synthetic Peptide
  SITE (7)..(7): Xaa is C, D, G, H, I, M, N, P, Q, V, W, or Y
FKSELRXL

SEQ ID NO: 1277 - protein, 8 aa, Artificial Sequence
  Description of Artificial Sequence: Synthetic Peptide
  SITE (7)..(7): Xaa is C, D, E, F, H, I, M, P, Q, R, T, V, W, or Y
FKSEISXI

SEQ ID NO: 1278 - protein, 8 aa, Artificial Sequence
  Description of Artificial Sequence: Synthetic Peptide
  SITE (7)..(7): Xaa is C, F, H, L, N, R, S, T, W, or Y
FKSELSXI

SEQ ID NO: 1279 - protein, 8 aa, Artificial Sequence
  Description of Artificial Sequence: Synthetic Peptide
  SITE (7)..(7): Xaa is A, C, D, E, F, G, I, L, M, R, W, or Y
FKSEISXL

SEQ ID NO: 1280 - protein, 8 aa, Artificial Sequence
  Description of Artificial Sequence: Synthetic Peptide
  SITE (7)..(7): Xaa is C, D, H, I, L, T, V, or W
FKSELSXL

SEQ ID NO: 1281 - protein, 8 aa, Artificial Sequence
  Description of Artificial Sequence: Synthetic Peptide
  SITE (7)..(7): Xaa is C, D, E, G, I, L, P, Q, R, S, V, W, or Y
FKSNIDXI

SEQ ID NO: 1282 - protein, 8 aa, Artificial Sequence
  Description of Artificial Sequence: Synthetic Peptide
  SITE (7)..(7): Xaa is A, C, D, E, F, G, H, I, K, M, N, P, Q, T, V, W, or Y
FKSNLDXI

SEQ ID NO: 1283 - protein, 8 aa, Artificial Sequence
  Description of Artificial Sequence: Synthetic Peptide
  SITE (7)..(7): Xaa is C, F, H, K, L, P, Q, T, or W
FKSNIDXL

SEQ ID NO: 1284 - protein, 8 aa, Artificial Sequence
  Description of Artificial Sequence: Synthetic Peptide
  SITE (7)..(7): Xaa is C, D, G, H, N, P, Q, R, S, T, V, W, or Y
FKSNLDXL

SEQ ID NO: 1285 - protein, 8 aa, Artificial Sequence
  Description of Artificial Sequence: Synthetic Peptide
  SITE (7)..(7): Xaa is C, E, F, G, K, L, M, N, Q, S, T, V, W, or Y
FKSNIRXI

SEQ ID NO: 1286 - protein, 8 aa, Artificial Sequence
  Description of Artificial Sequence: Synthetic Peptide
  SITE (7)..(7): Xaa is C, E, F, G, H, I, K, M, N, P, Q, R, S, T, V, or Y
FKSNLRXI

SEQ ID NO: 1287 - protein, 8 aa, Artificial Sequence
  Description of Artificial Sequence: Synthetic Peptide
  SITE (7)..(7): Xaa is C, D, E, F, G, H, K, P, Q, V, W, or Y
FKSNIRXL

SEQ ID NO: 1288 - protein, 8 aa, Artificial Sequence
  Description of Artificial Sequence: Synthetic Peptide
  SITE (7)..(7): Xaa is A, C, E, F, G, H, M, Q, T, V ,W, or Y
FKSNLRXL

SEQ ID NO: 1289 - protein, 8 aa, Artificial Sequence
  Description of Artificial Sequence: Synthetic Peptide
  SITE (7)..(7): Xaa is A, C, D, E, H, I, P, R, T, or Y
FKSNISXI

SEQ ID NO: 1290 - protein, 8 aa, Artificial Sequence
  Description of Artificial Sequence: Synthetic Peptide
  SITE (7)..(7): Xaa is A, C, F, G, H, P, Q, R, T, V, or Y
FKSNLSXI

SEQ ID NO: 1291 - protein, 8 aa, Artificial Sequence
  Description of Artificial Sequence: Synthetic Peptide
  SITE (7)..(7): Xaa is D, E, F, G, L, M, Q, R, T, or W
FKSNISXL

SEQ ID NO: 1292 - protein, 8 aa, Artificial Sequence
  Description of Artificial Sequence: Synthetic Peptide
  SITE (7)..(7): Xaa is A, C, D, E, F, G, H, M, Q, R, or W
FKSNLSXL

SEQ ID NO: 1293 - protein, 8 aa, Artificial Sequence
  Description of Artificial Sequence: Synthetic Peptide
  SITE (7)..(7): Xaa is A, C, D, F, G, H, K, M, P, Q, R, S, T, V, or Y
FKSQIDXI

SEQ ID NO: 1294 - protein, 8 aa, Artificial Sequence
  Description of Artificial Sequence: Synthetic Peptide
  SITE (7)..(7): Xaa is C, F, H, I, L, M, N, S, T, V, or Y
FKSQLDXI

SEQ ID NO: 1295 - protein, 8 aa, Artificial Sequence
  Description of Artificial Sequence: Synthetic Peptide
  SITE (7)..(7): Xaa is C, D, F, H, I, L, P, Q, S, T, V, or Y
FKSQIDXL

SEQ ID NO: 1296 - protein, 8 aa, Artificial Sequence
  Description of Artificial Sequence: Synthetic Peptide
  SITE (7)..(7): Xaa is A, C, E, F, H, M, N, P, Q, S, T, V, W, or Y
FKSQLDXL

SEQ ID NO: 1297 - protein, 8 aa, Artificial Sequence
  Description of Artificial Sequence: Synthetic Peptide
  SITE (7)..(7): Xaa is A, C, E, F, G, H, K, N, P, Q, R, V, W, or Y
FKSQIRXI

SEQ ID NO: 1298 - protein, 8 aa, Artificial Sequence
  Description of Artificial Sequence: Synthetic Peptide
  SITE (7)..(7): Xaa is C, D, E, F, G, H, I, M, P, R, T, V, W, or Y
FKSQLRXI

SEQ ID NO: 1299 - protein, 8 aa, Artificial Sequence
  Description of Artificial Sequence: Synthetic Peptide
  SITE (7)..(7): Xaa is A, C, D, G, H, K, N, P, Q, S, T, V, or W
FKSQIRXL

SEQ ID NO: 1300 - protein, 8 aa, Artificial Sequence
  Description of Artificial Sequence: Synthetic Peptide
  SITE (7)..(7): Xaa is A, C, F, G, H, I, L, M, N, P, Q, V, W, or Y
FKSQLRXL

SEQ ID NO: 1301 - protein, 8 aa, Artificial Sequence
  Description of Artificial Sequence: Synthetic Peptide
  SITE (7)..(7): Xaa is C, E, G, H, L, M, N, P, R, S, T, W, or Y
FKSQISXI

SEQ ID NO: 1302 - protein, 8 aa, Artificial Sequence
  Description of Artificial Sequence: Synthetic Peptide
  SITE (7)..(7): Xaa is C, F, I, M, P, Q, R, S, T, V, W, or Y
FKSQLSXI

SEQ ID NO: 1303 - protein, 8 aa, Artificial Sequence
  Description of Artificial Sequence: Synthetic Peptide
  SITE (7)..(7): Xaa is A, C, G, H, I, M, N, P, R, T, V, or Y
FKSQISXL

SEQ ID NO: 1304 - protein, 8 aa, Artificial Sequence
  Description of Artificial Sequence: Synthetic Peptide
  SITE (7)..(7): Xaa is C, H, I, M, N, Q, R, W, or Y
FKSQLSXL

SEQ ID NO: 1305 - protein, 8 aa, Artificial Sequence
  Description of Artificial Sequence: Synthetic Peptide
  SITE (7)..(7): Xaa is A, C, D, E, G, H, I, L, N, Q, R, S, W, or Y
FKSSIDXI

SEQ ID NO: 1306 - protein, 8 aa, Artificial Sequence
  Description of Artificial Sequence: Synthetic Peptide
  SITE (7)..(7): Xaa is A, C, D, F, G, H, I, M, P, R, T, W, or Y
FKSSLDXI

SEQ ID NO: 1307 - protein, 8 aa, Artificial Sequence
  Description of Artificial Sequence: Synthetic Peptide
  SITE (7)..(7): Xaa is H, I, M, N, P, Q, S, T, V, W, or Y
FKSSIDXL

SEQ ID NO: 1308 - protein, 8 aa, Artificial Sequence
  Description of Artificial Sequence: Synthetic Peptide
  SITE (7)..(7): Xaa is C, F, K, L, M, Q, T, W, or Y
FKSSLDXL

SEQ ID NO: 1309 - protein, 8 aa, Artificial Sequence
  Description of Artificial Sequence: Synthetic Peptide
  SITE (7)..(7): Xaa is C, F, G, H, L, M, P, Q, R, S, W, or Y
FKSSIRXI

SEQ ID NO: 1310 - protein, 8 aa, Artificial Sequence
  Description of Artificial Sequence: Synthetic Peptide
  SITE (7)..(7): Xaa is A, C, D, E, F, G, H, I, L, M, N, P, Q, R, T, V, or W
FKSSLRXI

SEQ ID NO: 1311 - protein, 8 aa, Artificial Sequence
  Description of Artificial Sequence: Synthetic Peptide
  SITE (7)..(7): Xaa is C, E, F, G, H, I, M, N, P, Q, R, V, or W
FKSSIRXL

SEQ ID NO: 1312 - protein, 8 aa, Artificial Sequence
  Description of Artificial Sequence: Synthetic Peptide
  SITE (7)..(7): Xaa is D, E, F, H, L, M, P, Q, R, T, or W
FKSSLRXL

SEQ ID NO: 1313 - protein, 8 aa, Artificial Sequence
  Description of Artificial Sequence: Synthetic Peptide
  SITE (7)..(7): Xaa is C, D, E, G, P, R, V, W, or Y
FKSSISXI

SEQ ID NO: 1314 - protein, 8 aa, Artificial Sequence
  Description of Artificial Sequence: Synthetic Peptide
  SITE (7)..(7): Xaa is C, D, E, F, G, I, M, R, or W
FKSSLSXI

SEQ ID NO: 1315 - protein, 8 aa, Artificial Sequence
  Description of Artificial Sequence: Synthetic Peptide
  SITE (7)..(7): Xaa is C, H, I, N, Q, or T
FKSSISXL

SEQ ID NO: 1316 - protein, 8 aa, Artificial Sequence
  Description of Artificial Sequence: Synthetic Peptide
  SITE (7)..(7): Xaa is C, I, L, T, or Y
FKSSLSXL

SEQ ID NO: 1317 - protein, 8 aa, Artificial Sequence
  Description of Artificial Sequence: Synthetic Peptide
IGSNLRAL

SEQ ID NO: 1318 - protein, 8 aa, Artificial Sequence
  Description of Artificial Sequence: Synthetic Peptide
  SITE (7)..(7): Xaa is C, I, M, Q V, or W
LGADIDXI

SEQ ID NO: 1319 - protein, 8 aa, Artificial Sequence
  Description of Artificial Sequence: Synthetic Peptide
  SITE (7)..(7): Xaa is C, N, P, Q, S, W, or Y
LGADLDXI

SEQ ID NO: 1320 - protein, 8 aa, Artificial Sequence
  Description of Artificial Sequence: Synthetic Peptide
  SITE (7)..(7): Xaa is F, M, or W
LGADIDXL

SEQ ID NO: 1321 - protein, 8 aa, Artificial Sequence
  Description of Artificial Sequence: Synthetic Peptide
LGADLDCL

SEQ ID NO: 1322 - protein, 8 aa, Artificial Sequence
  Description of Artificial Sequence: Synthetic Peptide
  SITE (7)..(7): Xaa is A, D, H, or W
LGADIRXI

SEQ ID NO: 1323 - protein, 8 aa, Artificial Sequence
  Description of Artificial Sequence: Synthetic Peptide
  SITE (7)..(7): Xaa is C, F, H, M, N, or W
LGADLRXI

SEQ ID NO: 1324 - protein, 8 aa, Artificial Sequence
  Description of Artificial Sequence: Synthetic Peptide
  SITE (7)..(7): Xaa is M or N
LGADIRXL

SEQ ID NO: 1325 - protein, 8 aa, Artificial Sequence
  Description of Artificial Sequence: Synthetic Peptide
  SITE (7)..(7): Xaa is C, F, H, M, P, or Y
LGADISXI

SEQ ID NO: 1326 - protein, 8 aa, Artificial Sequence
  Description of Artificial Sequence: Synthetic Peptide
  SITE (7)..(7): Xaa is C, I, M, N, W, or Y
LGADLSXI

SEQ ID NO: 1327 - protein, 8 aa, Artificial Sequence
  Description of Artificial Sequence: Synthetic Peptide
  SITE (7)..(7): Xaa is C, Q, or W
LGADISXL

SEQ ID NO: 1328 - protein, 8 aa, Artificial Sequence
  Description of Artificial Sequence: Synthetic Peptide
  SITE (7)..(7): Xaa is C or M
LGADLSXL

SEQ ID NO: 1329 - protein, 8 aa, Artificial Sequence
  Description of Artificial Sequence: Synthetic Peptide
  SITE (7)..(7): Xaa is H, I, M, N, or W
LGAEIDXI

SEQ ID NO: 1330 - protein, 8 aa, Artificial Sequence
  Description of Artificial Sequence: Synthetic Peptide
  SITE (7)..(7): Xaa is C, N, or W
LGAELDXI

SEQ ID NO: 1331 - protein, 8 aa, Artificial Sequence
  Description of Artificial Sequence: Synthetic Peptide
LGAEIDML

SEQ ID NO: 1332 - protein, 8 aa, Artificial Sequence
  Description of Artificial Sequence: Synthetic Peptide
  SITE (7)..(7): Xaa is C or Y
LGAELDXL

SEQ ID NO: 1333 - protein, 8 aa, Artificial Sequence
  Description of Artificial Sequence: Synthetic Peptide
  SITE (7)..(7): Xaa is D, H, M, or P
LGAEIRXI

SEQ ID NO: 1334 - protein, 8 aa, Artificial Sequence
  Description of Artificial Sequence: Synthetic Peptide
  SITE (7)..(7): Xaa is C, F, H, M, S, T, W, or Y
LGAELRXI

SEQ ID NO: 1335 - protein, 8 aa, Artificial Sequence
  Description of Artificial Sequence: Synthetic Peptide
  SITE (7)..(7): Xaa is C, K, or W
LGAEIRXL

SEQ ID NO: 1336 - protein, 8 aa, Artificial Sequence
  Description of Artificial Sequence: Synthetic Peptide
  SITE (7)..(7): Xaa is A, C, H, N, or W
LGAEISXI

SEQ ID NO: 1337 - protein, 8 aa, Artificial Sequence
  Description of Artificial Sequence: Synthetic Peptide
  SITE (7)..(7): Xaa is C, F, M, or W
LGAELSXI

SEQ ID NO: 1338 - protein, 8 aa, Artificial Sequence
  Description of Artificial Sequence: Synthetic Peptide
  SITE (7)..(7): Xaa is H, I, V, or W
LGAEISXL

SEQ ID NO: 1339 - protein, 8 aa, Artificial Sequence
  Description of Artificial Sequence: Synthetic Peptide
LGAELSCL

SEQ ID NO: 1340 - protein, 8 aa, Artificial Sequence
  Description of Artificial Sequence: Synthetic Peptide
  SITE (7)..(7): Xaa is C, L, N, P, or W
LGANIDXI

SEQ ID NO: 1341 - protein, 8 aa, Artificial Sequence
  Description of Artificial Sequence: Synthetic Peptide
  SITE (7)..(7): Xaa is C, F, N, S, T, V, or Y
LGANLDXI

SEQ ID NO: 1342 - protein, 8 aa, Artificial Sequence
  Description of Artificial Sequence: Synthetic Peptide
  SITE (7)..(7): Xaa is C, D, E, H, M, or W
LGANIDXL

SEQ ID NO: 1343 - protein, 8 aa, Artificial Sequence
  Description of Artificial Sequence: Synthetic Peptide
  SITE (7)..(7): Xaa is C, G, I, or M
LGANLDXL

SEQ ID NO: 1344 - protein, 8 aa, Artificial Sequence
  Description of Artificial Sequence: Synthetic Peptide
  SITE (7)..(7): Xaa is D, F, H, I, K, N, Q, S, V, W, or Y
LGANIRXI

SEQ ID NO: 1345 - protein, 8 aa, Artificial Sequence
  Description of Artificial Sequence: Synthetic Peptide
  SITE (7)..(7): Xaa is F, G, H, I, K, L, V, W, or Y
LGANLRXI

SEQ ID NO: 1346 - protein, 8 aa, Artificial Sequence
  Description of Artificial Sequence: Synthetic Peptide
  SITE (7)..(7): Xaa is A, C, D, E, H, K, L, M, N, P, or W
LGANIRXL

SEQ ID NO: 1347 - protein, 8 aa, Artificial Sequence
  Description of Artificial Sequence: Synthetic Peptide
  SITE (7)..(7): Xaa is C, F, I, K, M, N, or P
LGANLRXL

SEQ ID NO: 1348 - protein, 8 aa, Artificial Sequence
  Description of Artificial Sequence: Synthetic Peptide
  SITE (7)..(7): Xaa is D, F, M, Q, R, or W
LGANISXI

SEQ ID NO: 1349 - protein, 8 aa, Artificial Sequence
  Description of Artificial Sequence: Synthetic Peptide
  SITE (7)..(7): Xaa is C, E, H, I, K, M, N, R, or W
LGANLSXI

SEQ ID NO: 1350 - protein, 8 aa, Artificial Sequence
  Description of Artificial Sequence: Synthetic Peptide
LGANISHL

SEQ ID NO: 1351 - protein, 8 aa, Artificial Sequence
  Description of Artificial Sequence: Synthetic Peptide
  SITE (7)..(7): Xaa is C, F, or N
LGANLSXL

SEQ ID NO: 1352 - protein, 8 aa, Artificial Sequence
  Description of Artificial Sequence: Synthetic Peptide
  SITE (7)..(7): Xaa is C, D, E, H, M, T, or W
LGAQIDXI

SEQ ID NO: 1353 - protein, 8 aa, Artificial Sequence
  Description of Artificial Sequence: Synthetic Peptide
  SITE (7)..(7): Xaa is C, D, H, M, N, P, S, V, W, or Y
LGAQLDXI

SEQ ID NO: 1354 - protein, 8 aa, Artificial Sequence
  Description of Artificial Sequence: Synthetic Peptide
  SITE (7)..(7): Xaa is F, I, M, N, or W
LGAQIDXL

SEQ ID NO: 1355 - protein, 8 aa, Artificial Sequence
  Description of Artificial Sequence: Synthetic Peptide
  SITE (7)..(7): Xaa is C, H, N, W, or Y
LGAQLDXL

SEQ ID NO: 1356 - protein, 8 aa, Artificial Sequence
  Description of Artificial Sequence: Synthetic Peptide
  SITE (7)..(7): Xaa is A, G, H, I, P, Q, W, or Y
LGAQIRXI

SEQ ID NO: 1357 - protein, 8 aa, Artificial Sequence
  Description of Artificial Sequence: Synthetic Peptide
  SITE (7)..(7): Xaa is C, D, H, I, L, M, N, Q, W, or Y
LGAQLRXI

SEQ ID NO: 1358 - protein, 8 aa, Artificial Sequence
  Description of Artificial Sequence: Synthetic Peptide
  SITE (7)..(7): Xaa is C, G, K, N, S, or W
LGAQIRXL

SEQ ID NO: 1359 - protein, 8 aa, Artificial Sequence
  Description of Artificial Sequence: Synthetic Peptide
  SITE (7)..(7): Xaa is F or W
LGAQLRXL

SEQ ID NO: 1360 - protein, 8 aa, Artificial Sequence
  Description of Artificial Sequence: Synthetic Peptide
  SITE (7)..(7): Xaa is C, F, I, M, T, or W
LGAQISXI

SEQ ID NO: 1361 - protein, 8 aa, Artificial Sequence
  Description of Artificial Sequence: Synthetic Peptide
  SITE (7)..(7): Xaa is C, H, I, L, M, R, V, or W
LGAQLSXI

SEQ ID NO: 1362 - protein, 8 aa, Artificial Sequence
  Description of Artificial Sequence: Synthetic Peptide
  SITE (7)..(7): Xaa is C, F, K, M, Q, or W
LGAQISXL

SEQ ID NO: 1363 - protein, 8 aa, Artificial Sequence
  Description of Artificial Sequence: Synthetic Peptide
  SITE (7)..(7): Xaa is C, H, N, or W
LGAQLSXL

SEQ ID NO: 1364 - protein, 8 aa, Artificial Sequence
  Description of Artificial Sequence: Synthetic Peptide
  SITE (7)..(7): Xaa is C, F, H, I, M, N, or W
LGASIDXI

SEQ ID NO: 1365 - protein, 8 aa, Artificial Sequence
  Description of Artificial Sequence: Synthetic Peptide
  SITE (7)..(7): Xaa is C, H, or W
LGASLDXI

SEQ ID NO: 1366 - protein, 8 aa, Artificial Sequence
  Description of Artificial Sequence: Synthetic Peptide
  SITE (7)..(7): Xaa is C, H, or P
LGASIDXL

SEQ ID NO: 1367 - protein, 8 aa, Artificial Sequence
  Description of Artificial Sequence: Synthetic Peptide
  SITE (7)..(7): Xaa is C, F, H, I, K, or M
LGASIRXI

SEQ ID NO: 1368 - protein, 8 aa, Artificial Sequence
  Description of Artificial Sequence: Synthetic Peptide
  SITE (7)..(7): Xaa is C, F, or M
LGASLRXI

SEQ ID NO: 1369 - protein, 8 aa, Artificial Sequence
  Description of Artificial Sequence: Synthetic Peptide
  SITE (7)..(7): Xaa is H, K, P, W, or Y
LGASIRXL

SEQ ID NO: 1370 - protein, 8 aa, Artificial Sequence
  Description of Artificial Sequence: Synthetic Peptide
LGASLRCL

SEQ ID NO: 1371 - protein, 8 aa, Artificial Sequence
  Description of Artificial Sequence: Synthetic Peptide
  SITE (7)..(7): Xaa is C, H, M ,P, or W
LGASISXI

SEQ ID NO: 1372 - protein, 8 aa, Artificial Sequence
  Description of Artificial Sequence: Synthetic Peptide
LGASLSPI

SEQ ID NO: 1373 - protein, 8 aa, Artificial Sequence
  Description of Artificial Sequence: Synthetic Peptide
  SITE (7)..(7): Xaa is I, M, or W
LGASISXL

SEQ ID NO: 1374 - protein, 8 aa, Artificial Sequence
  Description of Artificial Sequence: Synthetic Peptide
  SITE (7)..(7): Xaa is C, D, F, H, I, M, N, Q, T, or W
LGGDIDXI

SEQ ID NO: 1375 - protein, 8 aa, Artificial Sequence
  Description of Artificial Sequence: Synthetic Peptide
  SITE (7)..(7): Xaa is H, M, P, or Y
LGGDLDXI

SEQ ID NO: 1376 - protein, 8 aa, Artificial Sequence
  Description of Artificial Sequence: Synthetic Peptide
  SITE (7)..(7): Xaa is C, H, M, Q, or S
LGGDIDXL

SEQ ID NO: 1377 - protein, 8 aa, Artificial Sequence
  Description of Artificial Sequence: Synthetic Peptide
  SITE (7)..(7): Xaa is C, M, or W
LGGDLDXL

SEQ ID NO: 1378 - protein, 8 aa, Artificial Sequence
  Description of Artificial Sequence: Synthetic Peptide
  SITE (7)..(7): Xaa is C, D, F, G, K, M, W, or Y
LGGDIRXI

SEQ ID NO: 1379 - protein, 8 aa, Artificial Sequence
  Description of Artificial Sequence: Synthetic Peptide
  SITE (7)..(7): Xaa is C, D, E, H, K, L, M, W, or Y
LGGDLRXI

SEQ ID NO: 1380 - protein, 8 aa, Artificial Sequence
  Description of Artificial Sequence: Synthetic Peptide
  SITE (7)..(7): Xaa is C, G, H, L, M, or W
LGGDIRXL

SEQ ID NO: 1381 - protein, 8 aa, Artificial Sequence
  Description of Artificial Sequence: Synthetic Peptide
  SITE (7)..(7): Xaa is F, M, N, W, or Y
LGGDLRXL

SEQ ID NO: 1382 - protein, 8 aa, Artificial Sequence
  Description of Artificial Sequence: Synthetic Peptide
  SITE (7)..(7): Xaa is C, F, H, I, L, M, Q, W, or Y
LGGDISXI

SEQ ID NO: 1383 - protein, 8 aa, Artificial Sequence
  Description of Artificial Sequence: Synthetic Peptide
  SITE (7)..(7): Xaa is D, M, or Q
LGGDLSXI

SEQ ID NO: 1384 - protein, 8 aa, Artificial Sequence
  Description of Artificial Sequence: Synthetic Peptide
  SITE (7)..(7): Xaa is H, M, or W
LGGDISXL

SEQ ID NO: 1385 - protein, 8 aa, Artificial Sequence
  Description of Artificial Sequence: Synthetic Peptide
LGGDLSIL

SEQ ID NO: 1386 - protein, 8 aa, Artificial Sequence
  Description of Artificial Sequence: Synthetic Peptide
  SITE (7)..(7): Xaa is C, M, or S
LGGEIDXI

SEQ ID NO: 1387 - protein, 8 aa, Artificial Sequence
  Description of Artificial Sequence: Synthetic Peptide
  SITE (7)..(7): Xaa is I, K, N, Q, or W
LGGELDXI

SEQ ID NO: 1388 - protein, 8 aa, Artificial Sequence
  Description of Artificial Sequence: Synthetic Peptide
  SITE (7)..(7): Xaa is H, P, or R
LGGEIDXL

SEQ ID NO: 1389 - protein, 8 aa, Artificial Sequence
  Description of Artificial Sequence: Synthetic Peptide
LGGELDWL

SEQ ID NO: 1390 - protein, 8 aa, Artificial Sequence
  Description of Artificial Sequence: Synthetic Peptide
  SITE (7)..(7): Xaa is C, D, F, I, M, V, W, or Y
LGGEIRXI

SEQ ID NO: 1391 - protein, 8 aa, Artificial Sequence
  Description of Artificial Sequence: Synthetic Peptide
  SITE (7)..(7): Xaa is C, F, H, M, or T
LGGELRXI

SEQ ID NO: 1392 - protein, 8 aa, Artificial Sequence
  Description of Artificial Sequence: Synthetic Peptide
  SITE (7)..(7): Xaa is H, N, or P
LGGEIRXL

SEQ ID NO: 1393 - protein, 8 aa, Artificial Sequence
  Description of Artificial Sequence: Synthetic Peptide
  SITE (7)..(7): Xaa is M or W
LGGELRXL

SEQ ID NO: 1394 - protein, 8 aa, Artificial Sequence
  Description of Artificial Sequence: Synthetic Peptide
  SITE (7)..(7): Xaa is E, H, I, P, W, and Y
LGGEISXI

SEQ ID NO: 1395 - protein, 8 aa, Artificial Sequence
  Description of Artificial Sequence: Synthetic Peptide
  SITE (7)..(7): Xaa is F, H, I, K, M, T, W, and Y
LGGELSXI

SEQ ID NO: 1396 - protein, 8 aa, Artificial Sequence
  Description of Artificial Sequence: Synthetic Peptide
  SITE (7)..(7): Xaa is C, G, H, M, and W
LGGEISXL

SEQ ID NO: 1397 - protein, 8 aa, Artificial Sequence
  Description of Artificial Sequence: Synthetic Peptide
  SITE (7)..(7): Xaa is C and W
LGGELSXL

SEQ ID NO: 1398 - protein, 8 aa, Artificial Sequence
  Description of Artificial Sequence: Synthetic Peptide
  SITE (7)..(7): Xaa is C, M, P, Q, T, W, or Y
LGGNIDXI

SEQ ID NO: 1399 - protein, 8 aa, Artificial Sequence
  Description of Artificial Sequence: Synthetic Peptide
  SITE (7)..(7): Xaa is F, G, N, W, or Y
LGGNLDXI

SEQ ID NO: 1400 - protein, 8 aa, Artificial Sequence
  Description of Artificial Sequence: Synthetic Peptide
  SITE (7)..(7): Xaa is C, F, M, or V
LGGNIDXL

SEQ ID NO: 1401 - protein, 8 aa, Artificial Sequence
  Description of Artificial Sequence: Synthetic Peptide
  SITE (7)..(7): Xaa is A, C, H, K, P, W, or Y
LGGNLDXL

SEQ ID NO: 1402 - protein, 8 aa, Artificial Sequence
  Description of Artificial Sequence: Synthetic Peptide
  SITE (7)..(7): Xaa is C, E, H, I, P, Q, S, W, or Y
LGGNIRXI

SEQ ID NO: 1403 - protein, 8 aa, Artificial Sequence
  Description of Artificial Sequence: Synthetic Peptide
  SITE (7)..(7): Xaa is D, K, M, N, P, R, or W
LGGNLRXI

SEQ ID NO: 1404 - protein, 8 aa, Artificial Sequence
  Description of Artificial Sequence: Synthetic Peptide
  SITE (7)..(7): Xaa is D, H, M, P, Q, S, or W
LGGNIRXL

SEQ ID NO: 1405 - protein, 8 aa, Artificial Sequence
  Description of Artificial Sequence: Synthetic Peptide
  SITE (7)..(7): Xaa is C, N, P, Q, T, W, or Y
LGGNLRXL

SEQ ID NO: 1406 - protein, 8 aa, Artificial Sequence
  Description of Artificial Sequence: Synthetic Peptide
  SITE (7)..(7): Xaa is D, Q, R, or W
LGGNISXI

SEQ ID NO: 1407 - protein, 8 aa, Artificial Sequence
  Description of Artificial Sequence: Synthetic Peptide
  SITE (7)..(7): Xaa is C, N, or  W,
LGGNLSXI

SEQ ID NO: 1408 - protein, 8 aa, Artificial Sequence
  Description of Artificial Sequence: Synthetic Peptide
  SITE (7)..(7): Xaa is C, D, F, I, M, P, or W
LGGNISXL

SEQ ID NO: 1409 - protein, 8 aa, Artificial Sequence
  Description of Artificial Sequence: Synthetic Peptide
  SITE (7)..(7): Xaa is E, K, Q, W, or Y
LGGNLSXL

SEQ ID NO: 1410 - protein, 8 aa, Artificial Sequence
  Description of Artificial Sequence: Synthetic Peptide
  SITE (7)..(7): Xaa is C, D, G, H, I, K, M, P, Q, S, W, or Y
LGGQIDXI

SEQ ID NO: 1411 - protein, 8 aa, Artificial Sequence
  Description of Artificial Sequence: Synthetic Peptide
  SITE (7)..(7): Xaa is C, L, M, N, P, Q, R, W, or Y
LGGQLDXI

SEQ ID NO: 1412 - protein, 8 aa, Artificial Sequence
  Description of Artificial Sequence: Synthetic Peptide
  SITE (7)..(7): Xaa is C, G, H, L, P, T, W, or Y
LGGQIDXL

SEQ ID NO: 1413 - protein, 8 aa, Artificial Sequence
  Description of Artificial Sequence: Synthetic Peptide
  SITE (7)..(7): Xaa is C, H, M, N, P, or W
LGGQLDXL

SEQ ID NO: 1414 - protein, 8 aa, Artificial Sequence
  Description of Artificial Sequence: Synthetic Peptide
  SITE (7)..(7): Xaa is C, E, F, G, H, I, K, M, N, P, R, or W
LGGQIRXI

SEQ ID NO: 1415 - protein, 8 aa, Artificial Sequence
  Description of Artificial Sequence: Synthetic Peptide
  SITE (7)..(7): Xaa is A, C, H, I, M, N, V, or W
LGGQLRXI

SEQ ID NO: 1416 - protein, 8 aa, Artificial Sequence
  Description of Artificial Sequence: Synthetic Peptide
  SITE (7)..(7): Xaa is A, C, D, E, G, I, K, L, M, N, R, T, V, or W
LGGQIRXL

SEQ ID NO: 1417 - protein, 8 aa, Artificial Sequence
  Description of Artificial Sequence: Synthetic Peptide
  SITE (7)..(7): Xaa is C, H, or M
LGGQLRXL

SEQ ID NO: 1418 - protein, 8 aa, Artificial Sequence
  Description of Artificial Sequence: Synthetic Peptide
  SITE (7)..(7): Xaa is A, C, D, F, K, N, R, S, T, or W
LGGQISXI

SEQ ID NO: 1419 - protein, 8 aa, Artificial Sequence
  Description of Artificial Sequence: Synthetic Peptide
  SITE (7)..(7): Xaa is A, C, F, G, I, L, V, or W
LGGQLSXI

SEQ ID NO: 1420 - protein, 8 aa, Artificial Sequence
  Description of Artificial Sequence: Synthetic Peptide
  SITE (7)..(7): Xaa is C, H, K, or M
LGGQISXL

SEQ ID NO: 1421 - protein, 8 aa, Artificial Sequence
  Description of Artificial Sequence: Synthetic Peptide
  SITE (7)..(7): Xaa is C, or W
LGGQLSXL

SEQ ID NO: 1422 - protein, 8 aa, Artificial Sequence
  Description of Artificial Sequence: Synthetic Peptide
  SITE (7)..(7): Xaa is C, G, I, K, N, P, R, V, or W
LGGSIDXI

SEQ ID NO: 1423 - protein, 8 aa, Artificial Sequence
  Description of Artificial Sequence: Synthetic Peptide
  SITE (7)..(7): Xaa is F, K, M, S, T, or W
LGGSLDXI

SEQ ID NO: 1424 - protein, 8 aa, Artificial Sequence
  Description of Artificial Sequence: Synthetic Peptide
  SITE (7)..(7): Xaa is H, M, or W
LGGSIDXL

SEQ ID NO: 1425 - protein, 8 aa, Artificial Sequence
  Description of Artificial Sequence: Synthetic Peptide
LGGSLDML

SEQ ID NO: 1426 - protein, 8 aa, Artificial Sequence
  Description of Artificial Sequence: Synthetic Peptide
  SITE (7)..(7): Xaa is C, D, G, H, I, K, M, N, T, W, or Y
LGGSIRXI

SEQ ID NO: 1427 - protein, 8 aa, Artificial Sequence
  Description of Artificial Sequence: Synthetic Peptide
  SITE (7)..(7): Xaa is C, F, G, H, or W
LGGSLRXI

SEQ ID NO: 1428 - protein, 8 aa, Artificial Sequence
  Description of Artificial Sequence: Synthetic Peptide
  SITE (7)..(7): Xaa is C, H, P, Q, or W
LGGSIRXL

SEQ ID NO: 1429 - protein, 8 aa, Artificial Sequence
  Description of Artificial Sequence: Synthetic Peptide
  SITE (7)..(7): Xaa is C
LGGSLRXL

SEQ ID NO: 1430 - protein, 8 aa, Artificial Sequence
  Description of Artificial Sequence: Synthetic Peptide
  SITE (7)..(7): Xaa is C, G, I, K, N, P, R, V, or W
LGGSISXI

SEQ ID NO: 1431 - protein, 8 aa, Artificial Sequence
  Description of Artificial Sequence: Synthetic Peptide
  SITE (7)..(7): Xaa is C, H, M, or P
LGGSLSXI

SEQ ID NO: 1432 - protein, 8 aa, Artificial Sequence
  Description of Artificial Sequence: Synthetic Peptide
  SITE (7)..(7): Xaa is C, H, P, Q, or W
LGGSISXL

SEQ ID NO: 1433 - protein, 8 aa, Artificial Sequence
  Description of Artificial Sequence: Synthetic Peptide
  SITE (7)..(7): Xaa is H, or M
LGGSLSXL

SEQ ID NO: 1434 - protein, 8 aa, Artificial Sequence
  Description of Artificial Sequence: Synthetic Peptide
  SITE (7)..(7): Xaa is F, G, H, P, W, or Y
LGLDIDXI

SEQ ID NO: 1435 - protein, 8 aa, Artificial Sequence
  Description of Artificial Sequence: Synthetic Peptide
  SITE (7)..(7): Xaa is C or W
LGLDLDXI

SEQ ID NO: 1436 - protein, 8 aa, Artificial Sequence
  Description of Artificial Sequence: Synthetic Peptide
  SITE (7)..(7): Xaa is C or H
LGLDIDXL

SEQ ID NO: 1437 - protein, 8 aa, Artificial Sequence
  Description of Artificial Sequence: Synthetic Peptide
LGLDLDCL

SEQ ID NO: 1438 - protein, 8 aa, Artificial Sequence
  Description of Artificial Sequence: Synthetic Peptide
  SITE (7)..(7): Xaa is C, I, M, T, or Y
LGLDIRXI

SEQ ID NO: 1439 - protein, 8 aa, Artificial Sequence
  Description of Artificial Sequence: Synthetic Peptide
  SITE (7)..(7): Xaa is C, F, or W
LGLDLRXI

SEQ ID NO: 1440 - protein, 8 aa, Artificial Sequence
  Description of Artificial Sequence: Synthetic Peptide
  SITE (7)..(7): Xaa is F, M, N, Q, W, or Y
LGLDIRXL

SEQ ID NO: 1441 - protein, 8 aa, Artificial Sequence
  Description of Artificial Sequence: Synthetic Peptide
  SITE (7)..(7): Xaa is C, W, or Y
LGLDLRXL

SEQ ID NO: 1442 - protein, 8 aa, Artificial Sequence
  Description of Artificial Sequence: Synthetic Peptide
  SITE (7)..(7): Xaa is C, Q, or W
LGLDISXI

SEQ ID NO: 1443 - protein, 8 aa, Artificial Sequence
  Description of Artificial Sequence: Synthetic Peptide
LGLDLSCI

SEQ ID NO: 1444 - protein, 8 aa, Artificial Sequence
  Description of Artificial Sequence: Synthetic Peptide
  SITE (7)..(7): Xaa is C, F, or W
LGLDISXL

SEQ ID NO: 1445 - protein, 8 aa, Artificial Sequence
  Description of Artificial Sequence: Synthetic Peptide
LGLDLSCL

SEQ ID NO: 1446 - protein, 8 aa, Artificial Sequence
  Description of Artificial Sequence: Synthetic Peptide
  SITE (7)..(7): Xaa is C, L, S, or W
LGLEIDXI

SEQ ID NO: 1447 - protein, 8 aa, Artificial Sequence
  Description of Artificial Sequence: Synthetic Peptide
  SITE (7)..(7): Xaa is A, C, I, M, or W
LGLELDXI

SEQ ID NO: 1448 - protein, 8 aa, Artificial Sequence
  Description of Artificial Sequence: Synthetic Peptide
  SITE (7)..(7): Xaa is C, F, H, K, P, R, or W
LGLEIDXL

SEQ ID NO: 1449 - protein, 8 aa, Artificial Sequence
  Description of Artificial Sequence: Synthetic Peptide
  SITE (7)..(7): Xaa is C, H, M, P, V, W, or Y
LGLELDXL

SEQ ID NO: 1450 - protein, 8 aa, Artificial Sequence
  Description of Artificial Sequence: Synthetic Peptide
  SITE (7)..(7): Xaa is C, E, F, I, L, M, Q, S, V, or W
LGLEIRXI

SEQ ID NO: 1451 - protein, 8 aa, Artificial Sequence
  Description of Artificial Sequence: Synthetic Peptide
  SITE (7)..(7): Xaa is C, Q, S, T, W, or Y
LGLELRXI

SEQ ID NO: 1452 - protein, 8 aa, Artificial Sequence
  Description of Artificial Sequence: Synthetic Peptide
  SITE (7)..(7): Xaa is C, F, H, M, S, T, W, or Y
LGLEIRXL

SEQ ID NO: 1453 - protein, 8 aa, Artificial Sequence
  Description of Artificial Sequence: Synthetic Peptide
  SITE (7)..(7): Xaa is C, F, H, L, M, N, or W
LGLEISXI

SEQ ID NO: 1454 - protein, 8 aa, Artificial Sequence
  Description of Artificial Sequence: Synthetic Peptide
  SITE (7)..(7): Xaa is I, M, N, W, or Y
LGLELSXI

SEQ ID NO: 1455 - protein, 8 aa, Artificial Sequence
  Description of Artificial Sequence: Synthetic Peptide
  SITE (7)..(7): Xaa is I, P, or Y
LGLEISXL

SEQ ID NO: 1456 - protein, 8 aa, Artificial Sequence
  Description of Artificial Sequence: Synthetic Peptide
  SITE (7)..(7): Xaa is C, M, W, or Y
LGLELSXL

SEQ ID NO: 1457 - protein, 8 aa, Artificial Sequence
  Description of Artificial Sequence: Synthetic Peptide
  SITE (7)..(7): Xaa is C, K, M, Q, S, T, or Y
LGLNIDXI

SEQ ID NO: 1458 - protein, 8 aa, Artificial Sequence
  Description of Artificial Sequence: Synthetic Peptide
  SITE (7)..(7): Xaa is F, H, M, T, or Y
LGLNLDXI

SEQ ID NO: 1459 - protein, 8 aa, Artificial Sequence
  Description of Artificial Sequence: Synthetic Peptide
  SITE (7)..(7): Xaa is C, P, Q, W, or Y
LGLNIDXL

SEQ ID NO: 1460 - protein, 8 aa, Artificial Sequence
  Description of Artificial Sequence: Synthetic Peptide
  SITE (7)..(7): Xaa is C, H, K, L, M, or R
LGLNLDXL

SEQ ID NO: 1461 - protein, 8 aa, Artificial Sequence
  Description of Artificial Sequence: Synthetic Peptide
  SITE (7)..(7): Xaa is A, C, D, G, H, K, L, M, N, P, Q, T, or W
LGLNIRXI

SEQ ID NO: 1462 - protein, 8 aa, Artificial Sequence
  Description of Artificial Sequence: Synthetic Peptide
  SITE (7)..(7): Xaa is C, G, H, I, K, L, M, T, V, W, or Y
LGLNLRXI

SEQ ID NO: 1463 - protein, 8 aa, Artificial Sequence
  Description of Artificial Sequence: Synthetic Peptide
  SITE (7)..(7): Xaa is C, F, M, N, P, Q, R, T, V, or W
LGLNIRXL

SEQ ID NO: 1464 - protein, 8 aa, Artificial Sequence
  Description of Artificial Sequence: Synthetic Peptide
  SITE (7)..(7): Xaa is A, C, K, or M
LGLNLRXL

SEQ ID NO: 1465 - protein, 8 aa, Artificial Sequence
  Description of Artificial Sequence: Synthetic Peptide
  SITE (7)..(7): Xaa is A, C, F, H, Q or W
LGLNISXI

SEQ ID NO: 1466 - protein, 8 aa, Artificial Sequence
  Description of Artificial Sequence: Synthetic Peptide
  SITE (7)..(7): Xaa is C, K, N, Q, or Y
LGLNLSXI

SEQ ID NO: 1467 - protein, 8 aa, Artificial Sequence
  Description of Artificial Sequence: Synthetic Peptide
  SITE (7)..(7): Xaa is C, E, F, G, H, or W
LGLNISXL

SEQ ID NO: 1468 - protein, 8 aa, Artificial Sequence
  Description of Artificial Sequence: Synthetic Peptide
  SITE (7)..(7): Xaa is M or W
LGLNLSXL

SEQ ID NO: 1469 - protein, 8 aa, Artificial Sequence
  Description of Artificial Sequence: Synthetic Peptide
  SITE (7)..(7): Xaa is A, E, F, I, K, N, P, Q, R, T, or W
LGLQIDXI

SEQ ID NO: 1470 - protein, 8 aa, Artificial Sequence
  Description of Artificial Sequence: Synthetic Peptide
  SITE (7)..(7): Xaa is C, I, K, M, or Y
LGLQIDXL

SEQ ID NO: 1471 - protein, 8 aa, Artificial Sequence
  Description of Artificial Sequence: Synthetic Peptide
  SITE (7)..(7): Xaa is C, E, G, I, K, M, or W
LGLQIDXL

SEQ ID NO: 1472 - protein, 8 aa, Artificial Sequence
  Description of Artificial Sequence: Synthetic Peptide
  SITE (7)..(7): Xaa is C, F, R, A, C, E, F, G, I, M, P, T, or V
LGLQLDXL

SEQ ID NO: 1473 - protein, 8 aa, Artificial Sequence
  Description of Artificial Sequence: Synthetic Peptide
  SITE (7)..(7): Xaa is A, C, E, F, H, I, K, L, M, N, O, Q, R, V, W, or Y
LGLQIRXI

SEQ ID NO: 1474 - protein, 8 aa, Artificial Sequence
  Description of Artificial Sequence: Synthetic Peptide
  SITE (7)..(7): Xaa is C, I, L, M, P, S, T, or W
LGLQLRXI

SEQ ID NO: 1475 - protein, 8 aa, Artificial Sequence
  Description of Artificial Sequence: Synthetic Peptide
  SITE (7)..(7): Xaa is C, D, E, M, P, R, S, or W
LGLQIRXL

SEQ ID NO: 1476 - protein, 8 aa, Artificial Sequence
  Description of Artificial Sequence: Synthetic Peptide
  SITE (7)..(7): Xaa is C, D, F, I, M, T, W, or Y
LGLQLRXL

SEQ ID NO: 1477 - protein, 8 aa, Artificial Sequence
  Description of Artificial Sequence: Synthetic Peptide
  SITE (7)..(7): Xaa is C, F, H, I, M, Q, R, S, V, or W
LGLQISXI

SEQ ID NO: 1478 - protein, 8 aa, Artificial Sequence
  Description of Artificial Sequence: Synthetic Peptide
  SITE (7)..(7): Xaa is C, I, M, N, Q, or Y
LGLQLSXI

SEQ ID NO: 1479 - protein, 8 aa, Artificial Sequence
  Description of Artificial Sequence: Synthetic Peptide
  SITE (7)..(7): Xaa is C, H, K, M, P, or Q
LGLQISXL

SEQ ID NO: 1480 - protein, 8 aa, Artificial Sequence
  Description of Artificial Sequence: Synthetic Peptide
  SITE (7)..(7): Xaa is H or M
LGLQLSXL

SEQ ID NO: 1481 - protein, 8 aa, Artificial Sequence
  Description of Artificial Sequence: Synthetic Peptide
  SITE (7)..(7): Xaa is F, M, P, W, or Y
LGLSIDXI

SEQ ID NO: 1482 - protein, 8 aa, Artificial Sequence
  Description of Artificial Sequence: Synthetic Peptide
  SITE (7)..(7): Xaa is C, F, H, or P
LGLSIDXL

SEQ ID NO: 1483 - protein, 8 aa, Artificial Sequence
  Description of Artificial Sequence: Synthetic Peptide
  SITE (7)..(7): Xaa is C, H, or Y
LGLSLDXL

SEQ ID NO: 1484 - protein, 8 aa, Artificial Sequence
  Description of Artificial Sequence: Synthetic Peptide
  SITE (7)..(7): Xaa is D, F, H, K, L, M, R, S, or Y
LGLSIRXI

SEQ ID NO: 1485 - protein, 8 aa, Artificial Sequence
  Description of Artificial Sequence: Synthetic Peptide
  SITE (7)..(7): Xaa is C, I, or Y
LGLSLRXI

SEQ ID NO: 1486 - protein, 8 aa, Artificial Sequence
  Description of Artificial Sequence: Synthetic Peptide
  SITE (7)..(7): Xaa is C, K, M, or V
LGLSIRXL

SEQ ID NO: 1487 - protein, 9 aa, Artificial Sequence
  Description of Artificial Sequence: Synthetic Peptide
  misc_feature (7)..(7): Xaa can be any naturally occurring amino acid
LGLSLRXCL

SEQ ID NO: 1488 - protein, 8 aa, Artificial Sequence
  Description of Artificial Sequence: Synthetic Peptide
LGLSISWI

SEQ ID NO: 1489 - protein, 8 aa, Artificial Sequence
  Description of Artificial Sequence: Synthetic Peptide
LGLSLSCI

SEQ ID NO: 1490 - protein, 8 aa, Artificial Sequence
  Description of Artificial Sequence: Synthetic Peptide
LGLSISHL

SEQ ID NO: 1491 - protein, 8 aa, Artificial Sequence
  Description of Artificial Sequence: Synthetic Peptide
  SITE (7)..(7): Xaa is C, H, I, K, L, N, T, or Y
LGNDIDXI

SEQ ID NO: 1492 - protein, 8 aa, Artificial Sequence
  Description of Artificial Sequence: Synthetic Peptide
  SITE (7)..(7): Xaa is C, G, H ,M, P, or W
LGNDLDXI

SEQ ID NO: 1493 - protein, 8 aa, Artificial Sequence
  Description of Artificial Sequence: Synthetic Peptide
  SITE (7)..(7): Xaa is G, H, M, P, or W
LGNDLDXI

SEQ ID NO: 1494 - protein, 8 aa, Artificial Sequence
  Description of Artificial Sequence: Synthetic Peptide
  SITE (7)..(7): Xaa is D, E, F, I, K, M, P, or W
LGNDIDXL

SEQ ID NO: 1495 - protein, 8 aa, Artificial Sequence
  Description of Artificial Sequence: Synthetic Peptide
  SITE (7)..(7): Xaa is C, F, M, V, or W
LGNDLDXL

SEQ ID NO: 1496 - protein, 8 aa, Artificial Sequence
  Description of Artificial Sequence: Synthetic Peptide
  SITE (7)..(7): Xaa is C, F, G, H ,I, M, T, or W
LGNDLRXI

SEQ ID NO: 1497 - protein, 8 aa, Artificial Sequence
  Description of Artificial Sequence: Synthetic Peptide
  SITE (7)..(7): Xaa is A, C,E, F, G, H, M, N, Q, T, W, or Y
LGNDIRXL

SEQ ID NO: 1498 - protein, 8 aa, Artificial Sequence
  Description of Artificial Sequence: Synthetic Peptide
  SITE (7)..(7): Xaa is C, D, G, H, I, M, P, V, W, or Y
LGNDLRXL

SEQ ID NO: 1499 - protein, 8 aa, Artificial Sequence
  Description of Artificial Sequence: Synthetic Peptide
  SITE (7)..(7): Xaa is C, D, E, F, H, I, K, L, P, S, T, V, W, or Y
LGNDISXI

SEQ ID NO: 1500 - protein, 8 aa, Artificial Sequence
  Description of Artificial Sequence: Synthetic Peptide
  SITE (7)..(7): Xaa is C, E, F, H, I, L, M, N, W, or Y
LGNDLSXI

SEQ ID NO: 1501 - protein, 8 aa, Artificial Sequence
  Description of Artificial Sequence: Synthetic Peptide
  SITE (7)..(7): Xaa is C, E, F, H, N, P, S, or W
LGNDISXL

SEQ ID NO: 1502 - protein, 8 aa, Artificial Sequence
  Description of Artificial Sequence: Synthetic Peptide
  SITE (7)..(7): Xaa is C, F, M, Q, W, or Y
LGNDLSXL

SEQ ID NO: 1503 - protein, 8 aa, Artificial Sequence
  Description of Artificial Sequence: Synthetic Peptide
  SITE (7)..(7): Xaa is A, C, D, K, L, M, N, P, Q, V, or Y
LGNEIDXI

SEQ ID NO: 1504 - protein, 8 aa, Artificial Sequence
  Description of Artificial Sequence: Synthetic Peptide
  SITE (7)..(7): Xaa is C, E, F, G, H, M, N, Q, V, or W
LGNELDXI

SEQ ID NO: 1505 - protein, 8 aa, Artificial Sequence
  Description of Artificial Sequence: Synthetic Peptide
  SITE (7)..(7): Xaa is A, C, D, F, H, I, M, N, P, T, V, W, or Y
LGNEIDXL

SEQ ID NO: 1506 - protein, 8 aa, Artificial Sequence
  Description of Artificial Sequence: Synthetic Peptide
  SITE (7)..(7): Xaa is C, I, M, N, Q, S, T, or W
LGNELDXL

SEQ ID NO: 1507 - protein, 8 aa, Artificial Sequence
  Description of Artificial Sequence: Synthetic Peptide
  SITE (7)..(7): Xaa is G, H, I, K, M, P, S, V, or W
LGNELRXI

SEQ ID NO: 1508 - protein, 8 aa, Artificial Sequence
  Description of Artificial Sequence: Synthetic Peptide
  SITE (7)..(7): Xaa is C, E, F, G, M, P, T, V, or W
LGNEIRXL

SEQ ID NO: 1509 - protein, 8 aa, Artificial Sequence
  Description of Artificial Sequence: Synthetic Peptide
  SITE (7)..(7): Xaa is C, M, N, V, or W
LGNELRXL

SEQ ID NO: 1510 - protein, 8 aa, Artificial Sequence
  Description of Artificial Sequence: Synthetic Peptide
  SITE (7)..(7): Xaa is C, E, H, I, or T
LGNEISXI

SEQ ID NO: 1511 - protein, 8 aa, Artificial Sequence
  Description of Artificial Sequence: Synthetic Peptide
  SITE (7)..(7): Xaa is C, H, I, N, Q, S, V, W, or Y
LGNELSXI

SEQ ID NO: 1512 - protein, 8 aa, Artificial Sequence
  Description of Artificial Sequence: Synthetic Peptide
  SITE (7)..(7): Xaa is E, F, M, Q, W, or Y
LGNEISXL

SEQ ID NO: 1513 - protein, 8 aa, Artificial Sequence
  Description of Artificial Sequence: Synthetic Peptide
  SITE (7)..(7): Xaa is C, D, E, H, I, T, W, or Y
LGNELSXL

SEQ ID NO: 1514 - protein, 8 aa, Artificial Sequence
  Description of Artificial Sequence: Synthetic Peptide
  SITE (7)..(7): Xaa is C, F, G, H, I, L, M, N, Q, R, S, or Y
LGNNIDXI

SEQ ID NO: 1515 - protein, 8 aa, Artificial Sequence
  Description of Artificial Sequence: Synthetic Peptide
  SITE (7)..(7): Xaa is A, C ,F, H, K, L, M, P, R, S, T, V, W, or Y
LGNNLDXI

SEQ ID NO: 1516 - protein, 8 aa, Artificial Sequence
  Description of Artificial Sequence: Synthetic Peptide
  SITE (7)..(7): Xaa is C, F, G, H, M, Q, S, V, W, or Y
LGNNIDXL

SEQ ID NO: 1517 - protein, 8 aa, Artificial Sequence
  Description of Artificial Sequence: Synthetic Peptide
  SITE (7)..(7): Xaa is F, G, H, M, R, V, or W
LGNNLDXL

SEQ ID NO: 1518 - protein, 8 aa, Artificial Sequence
  Description of Artificial Sequence: Synthetic Peptide
  SITE (7)..(7): Xaa is A, C, D, G, H, I, L, M, N, P, Q, R, S, V, W, or Y
LGNNIRXI

SEQ ID NO: 1519 - protein, 8 aa, Artificial Sequence
  Description of Artificial Sequence: Synthetic Peptide
  SITE (7)..(7): Xaa is A, C, D, F, G, H, L, Q, R, or W
LGNNLRXI

SEQ ID NO: 1520 - protein, 8 aa, Artificial Sequence
  Description of Artificial Sequence: Synthetic Peptide
  SITE (7)..(7): Xaa is A, C, E, F, G, H, P, Q, R, V, or W
LGNNIRXL

SEQ ID NO: 1521 - protein, 8 aa, Artificial Sequence
  Description of Artificial Sequence: Synthetic Peptide
  SITE (7)..(7): Xaa is C, H, L, N, P, S, V, W, or Y
LGNNLRXL

SEQ ID NO: 1522 - protein, 8 aa, Artificial Sequence
  Description of Artificial Sequence: Synthetic Peptide
  SITE (7)..(7): Xaa is A, C, F, H, I, M, N, P, Q, W, or Y
LGNNISXI

SEQ ID NO: 1523 - protein, 8 aa, Artificial Sequence
  Description of Artificial Sequence: Synthetic Peptide
  SITE (7)..(7): Xaa is A, C, D, F, L, M, N, Q, W, or Y
LGNNLSXI

SEQ ID NO: 1524 - protein, 8 aa, Artificial Sequence
  Description of Artificial Sequence: Synthetic Peptide
  SITE (7)..(7): Xaa is C, F, G, H, M, T, W, or Y
LGNNISXL

SEQ ID NO: 1525 - protein, 8 aa, Artificial Sequence
  Description of Artificial Sequence: Synthetic Peptide
  SITE (7)..(7): Xaa is C, H, K, M, S, or Y
LGNNLSXL

SEQ ID NO: 1526 - protein, 8 aa, Artificial Sequence
  Description of Artificial Sequence: Synthetic Peptide
  SITE (7)..(7): Xaa is C, D, E, F, G, H, I, K, N, P, S, T, or W
LGNQIDXI

SEQ ID NO: 1527 - protein, 8 aa, Artificial Sequence
  Description of Artificial Sequence: Synthetic Peptide
  SITE (7)..(7): Xaa is C, D, E, H, I, M, N, P, Q, S, V, w, or Y
LGNQLDXI

SEQ ID NO: 1528 - protein, 8 aa, Artificial Sequence
  Description of Artificial Sequence: Synthetic Peptide
  SITE (7)..(7): Xaa is C, E, F, H, I, K, L, M, N, P, Q, R, V, W, or Y
LGNQIDXL

SEQ ID NO: 1529 - protein, 8 aa, Artificial Sequence
  Description of Artificial Sequence: Synthetic Peptide
  SITE (7)..(7): Xaa is A, C, F, H, I, K, M, N, Q, W, or Y
LGNQLDXL

SEQ ID NO: 1530 - protein, 8 aa, Artificial Sequence
  Description of Artificial Sequence: Synthetic Peptide
  SITE (7)..(7): Xaa is A, C, F, G, H, I, K, M, N, P, R, V, W, or Y
LGNQIRXI

SEQ ID NO: 1531 - protein, 8 aa, Artificial Sequence
  Description of Artificial Sequence: Synthetic Peptide
  SITE (7)..(7): Xaa is A, C, E, F, G, H, I, M, R, T, V, W, or Y
LGNQLRXI

SEQ ID NO: 1532 - protein, 8 aa, Artificial Sequence
  Description of Artificial Sequence: Synthetic Peptide
  SITE (7)..(7): Xaa is C, D, F, H, L, M, N, Q, W, or Y
LGNQIRXL

SEQ ID NO: 1533 - protein, 8 aa, Artificial Sequence
  Description of Artificial Sequence: Synthetic Peptide
  SITE (7)..(7): Xaa is C, D, G, M, N, P, T, V, or Y
LGNQLRXL

SEQ ID NO: 1534 - protein, 8 aa, Artificial Sequence
  Description of Artificial Sequence: Synthetic Peptide
  SITE (7)..(7): Xaa is C, D, E, G, H, I, K, L, M, P,Q, S, T, V, W, or Y
LGNQISXI

SEQ ID NO: 1535 - protein, 8 aa, Artificial Sequence
  Description of Artificial Sequence: Synthetic Peptide
  SITE (7)..(7): Xaa is A, C, D, H, I, K, M, N, P, T, W, or Y
LGNQLSXI

SEQ ID NO: 1536 - protein, 8 aa, Artificial Sequence
  Description of Artificial Sequence: Synthetic Peptide
  SITE (7)..(7): Xaa is C, I, M, N, P, S, T, or Y
LGNQISXL

SEQ ID NO: 1537 - protein, 8 aa, Artificial Sequence
  Description of Artificial Sequence: Synthetic Peptide
  SITE (7)..(7): Xaa is C, H, I, K, L, M, N, P, Q, V, W, or Y
LGNQLSXL

SEQ ID NO: 1538 - protein, 8 aa, Artificial Sequence
  Description of Artificial Sequence: Synthetic Peptide
  SITE (7)..(7): Xaa is F, I, L, M, N, S, T, or W
LGNSIDXI

SEQ ID NO: 1539 - protein, 8 aa, Artificial Sequence
  Description of Artificial Sequence: Synthetic Peptide
  SITE (7)..(7): Xaa is C, D, I, M, N, Q, W, or Y
LGNSLDXI

SEQ ID NO: 1540 - protein, 8 aa, Artificial Sequence
  Description of Artificial Sequence: Synthetic Peptide
  SITE (7)..(7): Xaa is C, E, F, H, I, K, Q, R, S, or Y
LGNSIDXL

SEQ ID NO: 1541 - protein, 8 aa, Artificial Sequence
  Description of Artificial Sequence: Synthetic Peptide
  SITE (7)..(7): Xaa is C, G, M, W, or Y
LGNSLDXL

SEQ ID NO: 1542 - protein, 8 aa, Artificial Sequence
  Description of Artificial Sequence: Synthetic Peptide
  SITE (7)..(7): Xaa is A, C, D, G, H, I, L, M, V, or W
LGNSIRXI

SEQ ID NO: 1543 - protein, 8 aa, Artificial Sequence
  Description of Artificial Sequence: Synthetic Peptide
  SITE (7)..(7): Xaa is C, E, G, H, I, L, N, P, Q, or S
LGNSLRXI

SEQ ID NO: 1544 - protein, 8 aa, Artificial Sequence
  Description of Artificial Sequence: Synthetic Peptide
  SITE (7)..(7): Xaa is A, C, F, G, M, N, P, S, or W
LGNSIRXL

SEQ ID NO: 1545 - protein, 8 aa, Artificial Sequence
  Description of Artificial Sequence: Synthetic Peptide
  SITE (7)..(7): Xaa is C, H, N, or W
LGNSLRXL

SEQ ID NO: 1546 - protein, 8 aa, Artificial Sequence
  Description of Artificial Sequence: Synthetic Peptide
  SITE (7)..(7): Xaa is A, C, F, H, K, M, R, W, or Y
LGNSISXI

SEQ ID NO: 1547 - protein, 8 aa, Artificial Sequence
  Description of Artificial Sequence: Synthetic Peptide
  SITE (7)..(7): Xaa is D, H, or R
LGNSLSXI

SEQ ID NO: 1548 - protein, 8 aa, Artificial Sequence
  Description of Artificial Sequence: Synthetic Peptide
  SITE (7)..(7): Xaa is C, H, M, or W
LGNSISXL

SEQ ID NO: 1549 - protein, 8 aa, Artificial Sequence
  Description of Artificial Sequence: Synthetic Peptide
  SITE (7)..(7): Xaa is H, Q, S, or W
LGNSLSXL

SEQ ID NO: 1550 - protein, 8 aa, Artificial Sequence
  Description of Artificial Sequence: Synthetic Peptide
  SITE (7)..(7): Xaa is H, M, N, P, R, or V
LGSDIDXI

SEQ ID NO: 1551 - protein, 8 aa, Artificial Sequence
  Description of Artificial Sequence: Synthetic Peptide
  SITE (7)..(7): Xaa is D, F, H, I, V, W, or Y
LGSDLDXI

SEQ ID NO: 1552 - protein, 8 aa, Artificial Sequence
  Description of Artificial Sequence: Synthetic Peptide
  SITE (7)..(7): Xaa is A, E, P, W, or Y
LGSDIDXL

SEQ ID NO: 1553 - protein, 8 aa, Artificial Sequence
  Description of Artificial Sequence: Synthetic Peptide
  SITE (7)..(7): Xaa is C, D, H, W, or Y
LGSDLDXL

SEQ ID NO: 1554 - protein, 8 aa, Artificial Sequence
  Description of Artificial Sequence: Synthetic Peptide
  SITE (7)..(7): Xaa is C, K, M, P, R, S, W, or Y
LGSDIRXI

SEQ ID NO: 1555 - protein, 8 aa, Artificial Sequence
  Description of Artificial Sequence: Synthetic Peptide
  SITE (7)..(7): Xaa is C, D, F, H, T, or W
LGSDLRXI

SEQ ID NO: 1556 - protein, 8 aa, Artificial Sequence
  Description of Artificial Sequence: Synthetic Peptide
  SITE (7)..(7): Xaa is H, I, K, L, M, T, W, or Y
LGSDIRXL

SEQ ID NO: 1557 - protein, 8 aa, Artificial Sequence
  Description of Artificial Sequence: Synthetic Peptide
  SITE (7)..(7): Xaa is C, H, or W
LGSDLRXL

SEQ ID NO: 1558 - protein, 8 aa, Artificial Sequence
  Description of Artificial Sequence: Synthetic Peptide
  SITE (7)..(7): Xaa is A, C, L, M, N, P, Q, S, T, or W
LGSDISXI

SEQ ID NO: 1559 - protein, 8 aa, Artificial Sequence
  Description of Artificial Sequence: Synthetic Peptide
  SITE (7)..(7): Xaa is C, E, H, I, K, M, N, W, or Y
LGSDLSXI

SEQ ID NO: 1560 - protein, 8 aa, Artificial Sequence
  Description of Artificial Sequence: Synthetic Peptide
  SITE (7)..(7): Xaa is C, F, M, or P
LGSDISXL

SEQ ID NO: 1561 - protein, 8 aa, Artificial Sequence
  Description of Artificial Sequence: Synthetic Peptide
  SITE (7)..(7): Xaa is C, F, P, T, W, or Y
LGSDLSXL

SEQ ID NO: 1562 - protein, 8 aa, Artificial Sequence
  Description of Artificial Sequence: Synthetic Peptide
  SITE (7)..(7): Xaa is A, C, F, H, K, L, or S
LGSEIDXI

SEQ ID NO: 1563 - protein, 8 aa, Artificial Sequence
  Description of Artificial Sequence: Synthetic Peptide
  SITE (7)..(7): Xaa is C, E, H, K, M, N, T, or W
LGSELDXI

SEQ ID NO: 1564 - protein, 8 aa, Artificial Sequence
  Description of Artificial Sequence: Synthetic Peptide
  SITE (7)..(7): Xaa is F, H, P, V, or W
LGSEIDXL

SEQ ID NO: 1565 - protein, 8 aa, Artificial Sequence
  Description of Artificial Sequence: Synthetic Peptide
  SITE (7)..(7): Xaa is H, M, N, S, W, or Y
LGSELDXL

SEQ ID NO: 1566 - protein, 8 aa, Artificial Sequence
  Description of Artificial Sequence: Synthetic Peptide
  SITE (7)..(7): Xaa is C, D, H, I, L, M, P, W, or Y
LGSEIRXI

SEQ ID NO: 1567 - protein, 8 aa, Artificial Sequence
  Description of Artificial Sequence: Synthetic Peptide
  SITE (7)..(7): Xaa is C, H, M, W, or Y
LGSELRXI

SEQ ID NO: 1568 - protein, 8 aa, Artificial Sequence
  Description of Artificial Sequence: Synthetic Peptide
  SITE (7)..(7): Xaa is M, N, W, or Y
LGSEIRXL

SEQ ID NO: 1569 - protein, 8 aa, Artificial Sequence
  Description of Artificial Sequence: Synthetic Peptide
  SITE (7)..(7): Xaa is C, F, I, or W
LGSELRXL

SEQ ID NO: 1570 - protein, 8 aa, Artificial Sequence
  Description of Artificial Sequence: Synthetic Peptide
  SITE (7)..(7): Xaa is D, H, L, M, N, P, or W
LGSEISXI

SEQ ID NO: 1571 - protein, 8 aa, Artificial Sequence
  Description of Artificial Sequence: Synthetic Peptide
  SITE (7)..(7): Xaa is C, F, H, M, P, S, or W
LGSELSXI

SEQ ID NO: 1572 - protein, 8 aa, Artificial Sequence
  Description of Artificial Sequence: Synthetic Peptide
  SITE (7)..(7): Xaa is D, H, M, N, Q, T, or W
LGSEISXL

SEQ ID NO: 1573 - protein, 8 aa, Artificial Sequence
  Description of Artificial Sequence: Synthetic Peptide
  SITE (7)..(7): Xaa is M, or W
LGSELSXL

SEQ ID NO: 1574 - protein, 8 aa, Artificial Sequence
  Description of Artificial Sequence: Synthetic Peptide
  SITE (7)..(7): Xaa is A, C, F, G, I, P, S, V, or W
LGSNIDXI

SEQ ID NO: 1575 - protein, 8 aa, Artificial Sequence
  Description of Artificial Sequence: Synthetic Peptide
  SITE (7)..(7): Xaa is C, D, F, I, K, M, N, P, T, V, W, or Y
LGSNLDXI

SEQ ID NO: 1576 - protein, 8 aa, Artificial Sequence
  Description of Artificial Sequence: Synthetic Peptide
  SITE (7)..(7): Xaa is C, D, E, F, H, N, P, W, or Y
LGSNIDXL

SEQ ID NO: 1577 - protein, 8 aa, Artificial Sequence
  Description of Artificial Sequence: Synthetic Peptide
  SITE (7)..(7): Xaa is H, I, K, or N
LGSNLDXL

SEQ ID NO: 1578 - protein, 8 aa, Artificial Sequence
  Description of Artificial Sequence: Synthetic Peptide
  SITE (7)..(7): Xaa is A, C, E, F, H, L, M, Q, S, V, W, or Y
LGSNIRXI

SEQ ID NO: 1579 - protein, 8 aa, Artificial Sequence
  Description of Artificial Sequence: Synthetic Peptide
  SITE (7)..(7): Xaa is F, G, or Y
LGSNISXI

SEQ ID NO: 1580 - protein, 8 aa, Artificial Sequence
  Description of Artificial Sequence: Synthetic Peptide
  SITE (7)..(7): Xaa is C, H, L, R, or T
LGSNLSXI

SEQ ID NO: 1581 - protein, 8 aa, Artificial Sequence
  Description of Artificial Sequence: Synthetic Peptide
  SITE (7)..(7): Xaa is C, D, F, H, M, or P
LGSNISXL

SEQ ID NO: 1582 - protein, 8 aa, Artificial Sequence
  Description of Artificial Sequence: Synthetic Peptide
  SITE (7)..(7): Xaa is H, K, M, N, P, or Q
LGSNLSXL

SEQ ID NO: 1583 - protein, 8 aa, Artificial Sequence
  Description of Artificial Sequence: Synthetic Peptide
  SITE (7)..(7): Xaa is C, D, E, F, H, K, M, P, R, T, V, or Y
LGSQIDXI

SEQ ID NO: 1584 - protein, 8 aa, Artificial Sequence
  Description of Artificial Sequence: Synthetic Peptide
  SITE (7)..(7): Xaa is H, K, L, M, P, W, or Y
LGSQLDXI

SEQ ID NO: 1585 - protein, 8 aa, Artificial Sequence
  Description of Artificial Sequence: Synthetic Peptide
  SITE (7)..(7): Xaa is C, D, E, F, G, H, M, N, W, or Y
LGSQIDXL

SEQ ID NO: 1586 - protein, 8 aa, Artificial Sequence
  Description of Artificial Sequence: Synthetic Peptide
  SITE (7)..(7): Xaa is H, L, M, W, or Y
LGSQLDXL

SEQ ID NO: 1587 - protein, 8 aa, Artificial Sequence
  Description of Artificial Sequence: Synthetic Peptide
  SITE (7)..(7): Xaa is A, C, F, G, H, I, K, M, R, S, T, V, or W
LGSQIRXI

SEQ ID NO: 1588 - protein, 8 aa, Artificial Sequence
  Description of Artificial Sequence: Synthetic Peptide
  SITE (7)..(7): Xaa is A, C, F, H, I, K, L, M, P, S, T, V, or W
LGSQLRXI

SEQ ID NO: 1589 - protein, 8 aa, Artificial Sequence
  Description of Artificial Sequence: Synthetic Peptide
  SITE (7)..(7): Xaa is A, C, E, F, G, H, I, K, M, N, P, S, or W
LGSQIRXL

SEQ ID NO: 1590 - protein, 8 aa, Artificial Sequence
  Description of Artificial Sequence: Synthetic Peptide
  SITE (7)..(7): Xaa is F, H, M, N, W, or Y
LGSQLRXL

SEQ ID NO: 1591 - protein, 8 aa, Artificial Sequence
  Description of Artificial Sequence: Synthetic Peptide
  SITE (7)..(7): Xaa is C, D, F, H, P, Q, R, or W
LGSQISXI

SEQ ID NO: 1592 - protein, 8 aa, Artificial Sequence
  Description of Artificial Sequence: Synthetic Peptide
  SITE (7)..(7): Xaa is C, D, G, H, I, or W
LGSQLSXI

SEQ ID NO: 1593 - protein, 8 aa, Artificial Sequence
  Description of Artificial Sequence: Synthetic Peptide
  SITE (7)..(7): Xaa is C, H, I, K, N, P, R, S, V, or W
LGSQISXL

SEQ ID NO: 1594 - protein, 8 aa, Artificial Sequence
  Description of Artificial Sequence: Synthetic Peptide
  SITE (7)..(7): Xaa is C, F, H, N, W, or Y
LGSQLSXL

SEQ ID NO: 1595 - protein, 8 aa, Artificial Sequence
  Description of Artificial Sequence: Synthetic Peptide
  SITE (7)..(7): Xaa is C, D, F, H, I, M, P, T, or W
LGSSIDXI

SEQ ID NO: 1596 - protein, 8 aa, Artificial Sequence
  Description of Artificial Sequence: Synthetic Peptide
  SITE (7)..(7): Xaa is C, F, I, P, T, W, or Y
LGSSLDXI

SEQ ID NO: 1597 - protein, 8 aa, Artificial Sequence
  Description of Artificial Sequence: Synthetic Peptide
  SITE (7)..(7): Xaa is C, E, M, or Y
LGSSIDXL

SEQ ID NO: 1598 - protein, 8 aa, Artificial Sequence
  Description of Artificial Sequence: Synthetic Peptide
  SITE (7)..(7): Xaa is M, or Y
LGSSLDXL

SEQ ID NO: 1599 - protein, 8 aa, Artificial Sequence
  Description of Artificial Sequence: Synthetic Peptide
  SITE (7)..(7): Xaa is A, C, F, G, H, L, M, N, or Q
LGSSIRXI

SEQ ID NO: 1600 - protein, 8 aa, Artificial Sequence
  Description of Artificial Sequence: Synthetic Peptide
  SITE (7)..(7): Xaa is C, F, H, I, M, or W
LGSSLRXI

SEQ ID NO: 1601 - protein, 8 aa, Artificial Sequence
  Description of Artificial Sequence: Synthetic Peptide
  SITE (7)..(7): Xaa is C, D, F, H, P, R, or W
LGSSIRXL

SEQ ID NO: 1602 - protein, 8 aa, Artificial Sequence
  Description of Artificial Sequence: Synthetic Peptide
  SITE (7)..(7): Xaa is C or M
LGSSLRXL

SEQ ID NO: 1603 - protein, 8 aa, Artificial Sequence
  Description of Artificial Sequence: Synthetic Peptide
  SITE (7)..(7): Xaa is C, H, K, P, or Q
LGSSISXI

SEQ ID NO: 1604 - protein, 8 aa, Artificial Sequence
  Description of Artificial Sequence: Synthetic Peptide
  SITE (7)..(7): Xaa is C or H
LGSSLSXI

SEQ ID NO: 1605 - protein, 8 aa, Artificial Sequence
  Description of Artificial Sequence: Synthetic Peptide
  SITE (7)..(7): Xaa is C or W
LGSSISXL

SEQ ID NO: 1606 - protein, 8 aa, Artificial Sequence
  Description of Artificial Sequence: Synthetic Peptide
LGSSLSCL

SEQ ID NO: 1607 - protein, 8 aa, Artificial Sequence
  Description of Artificial Sequence: Synthetic Peptide
  SITE (7)..(7): Xaa is C, D, E, G, H, I, K, M, Q, W, or Y
LKADIDXI

SEQ ID NO: 1608 - protein, 8 aa, Artificial Sequence
  Description of Artificial Sequence: Synthetic Peptide
  SITE (7)..(7): Xaa is C, M, N, or W
LKADLDXI

SEQ ID NO: 1609 - protein, 8 aa, Artificial Sequence
  Description of Artificial Sequence: Synthetic Peptide
  SITE (7)..(7): Xaa is F or M
LKADIDXL

SEQ ID NO: 1610 - protein, 8 aa, Artificial Sequence
  Description of Artificial Sequence: Synthetic Peptide
LKADLDCL

SEQ ID NO: 1611 - protein, 8 aa, Artificial Sequence
  Description of Artificial Sequence: Synthetic Peptide
  SITE (7)..(7): Xaa is C, D, E, G, H, K, M, N, Q, R, S, or W
LKADIRXI

SEQ ID NO: 1612 - protein, 8 aa, Artificial Sequence
  Description of Artificial Sequence: Synthetic Peptide
  SITE (7)..(7): Xaa is F, H, I, Q, R, or W
LKADLRXI

SEQ ID NO: 1613 - protein, 8 aa, Artificial Sequence
  Description of Artificial Sequence: Synthetic Peptide
  SITE (7)..(7): Xaa is C, H, Q, V, W, or Y
LKADIRXL

SEQ ID NO: 1614 - protein, 8 aa, Artificial Sequence
  Description of Artificial Sequence: Synthetic Peptide
  SITE (7)..(7): Xaa is C, H, M, N, or W
LKADLRXL

SEQ ID NO: 1615 - protein, 8 aa, Artificial Sequence
  Description of Artificial Sequence: Synthetic Peptide
  SITE (7)..(7): Xaa is C, F, H, M ,T ,W ,or Y
LKADISXI

SEQ ID NO: 1616 - protein, 8 aa, Artificial Sequence
  Description of Artificial Sequence: Synthetic Peptide
  SITE (7)..(7): Xaa is A, C, H, M, P, Q, W, or Y
LKADLSXI

SEQ ID NO: 1617 - protein, 8 aa, Artificial Sequence
  Description of Artificial Sequence: Synthetic Peptide
  SITE (7)..(7): Xaa is C, M, P, or W
LKADISXL

SEQ ID NO: 1618 - protein, 8 aa, Artificial Sequence
  Description of Artificial Sequence: Synthetic Peptide
  SITE (7)..(7): Xaa is C, R, or W
LKADLSXL

SEQ ID NO: 1619 - protein, 8 aa, Artificial Sequence
  Description of Artificial Sequence: Synthetic Peptide
  SITE (7)..(7): Xaa is C, I, L, M, W, or Y
LKAEIDXI

SEQ ID NO: 1620 - protein, 8 aa, Artificial Sequence
  Description of Artificial Sequence: Synthetic Peptide
LKAELDYI

SEQ ID NO: 1621 - protein, 8 aa, Artificial Sequence
  Description of Artificial Sequence: Synthetic Peptide
  SITE (7)..(7): Xaa is C, F, or P
LKAEIDXL

SEQ ID NO: 1622 - protein, 8 aa, Artificial Sequence
  Description of Artificial Sequence: Synthetic Peptide
LKAELDPL

SEQ ID NO: 1623 - protein, 8 aa, Artificial Sequence
  Description of Artificial Sequence: Synthetic Peptide
  SITE (7)..(7): Xaa is C, F, H, I, L, M, W, or Y
LKAEIRXI

SEQ ID NO: 1624 - protein, 8 aa, Artificial Sequence
  Description of Artificial Sequence: Synthetic Peptide
  SITE (7)..(7): Xaa is C, L, M, V, or W
LKAELRXI

SEQ ID NO: 1625 - protein, 8 aa, Artificial Sequence
  Description of Artificial Sequence: Synthetic Peptide
  SITE (7)..(7): Xaa is H, I, L, M, V, W, or Y
LKAEIRXL

SEQ ID NO: 1626 - protein, 8 aa, Artificial Sequence
  Description of Artificial Sequence: Synthetic Peptide
  SITE (7)..(7): Xaa is F, H, M, or W
LKAELRXL

SEQ ID NO: 1627 - protein, 8 aa, Artificial Sequence
  Description of Artificial Sequence: Synthetic Peptide
  SITE (7)..(7): Xaa is C, F, H, M, V, or W
LKAEISXI

SEQ ID NO: 1628 - protein, 8 aa, Artificial Sequence
  Description of Artificial Sequence: Synthetic Peptide
  SITE (7)..(7): Xaa is C, M, P, V, or W
LKAELSXI

SEQ ID NO: 1629 - protein, 8 aa, Artificial Sequence
  Description of Artificial Sequence: Synthetic Peptide
  SITE (7)..(7): Xaa is C, F, I, M, W, or Y
LKAEISXL

SEQ ID NO: 1630 - protein, 8 aa, Artificial Sequence
  Description of Artificial Sequence: Synthetic Peptide
  SITE (7)..(7): Xaa is C, W, or Y
LKAELSXL

SEQ ID NO: 1631 - protein, 8 aa, Artificial Sequence
  Description of Artificial Sequence: Synthetic Peptide
  SITE (7)..(7): Xaa is C, D, E, G, H, I, M, Q, T, or V
LKANIDXI

SEQ ID NO: 1632 - protein, 8 aa, Artificial Sequence
  Description of Artificial Sequence: Synthetic Peptide
  SITE (7)..(7): Xaa is C, I, M, or W
LKANLDXI

SEQ ID NO: 1633 - protein, 8 aa, Artificial Sequence
  Description of Artificial Sequence: Synthetic Peptide
  SITE (7)..(7): Xaa is C, F, H, M, W, or Y
LKANIDXL

SEQ ID NO: 1634 - protein, 8 aa, Artificial Sequence
  Description of Artificial Sequence: Synthetic Peptide
  SITE (7)..(7): Xaa is M or W
LKANLDXL

SEQ ID NO: 1635 - protein, 8 aa, Artificial Sequence
  Description of Artificial Sequence: Synthetic Peptide
  SITE (7)..(7): Xaa is A, C, D, H, K, M, P, Q, R, T, or W
LKANIRXI

SEQ ID NO: 1636 - protein, 8 aa, Artificial Sequence
  Description of Artificial Sequence: Synthetic Peptide
  SITE (7)..(7): Xaa is C, G, M, N, Q, R, S, T, V, W, or Y
LKANLRXI

SEQ ID NO: 1637 - protein, 8 aa, Artificial Sequence
  Description of Artificial Sequence: Synthetic Peptide
  SITE (7)..(7): Xaa is A, C, H, M, P, R, V, W, or Y
LKANIRXL

SEQ ID NO: 1638 - protein, 8 aa, Artificial Sequence
  Description of Artificial Sequence: Synthetic Peptide
  SITE (7)..(7): Xaa is C, F, H, K, M, R, W, or Y
LKANLRXL

SEQ ID NO: 1639 - protein, 8 aa, Artificial Sequence
  Description of Artificial Sequence: Synthetic Peptide
  SITE (7)..(7): Xaa is C, F, G, H, W, or Y
LKANLSXI

SEQ ID NO: 1640 - protein, 8 aa, Artificial Sequence
  Description of Artificial Sequence: Synthetic Peptide
  SITE (7)..(7): Xaa is E, I, or P
LKANISXL

SEQ ID NO: 1641 - protein, 8 aa, Artificial Sequence
  Description of Artificial Sequence: Synthetic Peptide
  SITE (7)..(7): Xaa is G, H, M, or Y
LKANLSXL

SEQ ID NO: 1642 - protein, 8 aa, Artificial Sequence
  Description of Artificial Sequence: Synthetic Peptide
  SITE (7)..(7): Xaa is C, H, I, N, P, or Y
LKAQIDXI

SEQ ID NO: 1643 - protein, 8 aa, Artificial Sequence
  Description of Artificial Sequence: Synthetic Peptide
  SITE (7)..(7): Xaa is C, F, M, W, or Y
LKAQLDXI

SEQ ID NO: 1644 - protein, 8 aa, Artificial Sequence
  Description of Artificial Sequence: Synthetic Peptide
  SITE (7)..(7): Xaa is F, M, or P
LKAQIDXL

SEQ ID NO: 1645 - protein, 8 aa, Artificial Sequence
  Description of Artificial Sequence: Synthetic Peptide
  SITE (7)..(7): Xaa is C or F
LKAQLDXL

SEQ ID NO: 1646 - protein, 8 aa, Artificial Sequence
  Description of Artificial Sequence: Synthetic Peptide
  SITE (7)..(7): Xaa is C, G, H, I, K, M, Q, R, T, V, W, or Y
LKAQIRXI

SEQ ID NO: 1647 - protein, 8 aa, Artificial Sequence
  Description of Artificial Sequence: Synthetic Peptide
  SITE (7)..(7): Xaa is C, D, F, H, I, L, M, T, or W
LKAQLRXI

SEQ ID NO: 1648 - protein, 8 aa, Artificial Sequence
  Description of Artificial Sequence: Synthetic Peptide
  SITE (7)..(7): Xaa is C, F, I, L, M, P, R, S, W, or Y
LKAQIRXL

SEQ ID NO: 1649 - protein, 8 aa, Artificial Sequence
  Description of Artificial Sequence: Synthetic Peptide
  SITE (7)..(7): Xaa is C, I, L, W, or Y
LKAQLRXL

SEQ ID NO: 1650 - protein, 8 aa, Artificial Sequence
  Description of Artificial Sequence: Synthetic Peptide
  SITE (7)..(7): Xaa is C, I, P, R, V, or W
LKAQISXI

SEQ ID NO: 1651 - protein, 8 aa, Artificial Sequence
  Description of Artificial Sequence: Synthetic Peptide
  SITE (7)..(7): Xaa is C, F, G, H, P, W, or Y
LKAQLSXI

SEQ ID NO: 1652 - protein, 8 aa, Artificial Sequence
  Description of Artificial Sequence: Synthetic Peptide
  SITE (7)..(7): Xaa is C, H, M, W, or Y
LKAQISXL

SEQ ID NO: 1653 - protein, 8 aa, Artificial Sequence
  Description of Artificial Sequence: Synthetic Peptide
  SITE (7)..(7): Xaa is F, I, M, P, W, or Y
LKAQLSXL

SEQ ID NO: 1654 - protein, 8 aa, Artificial Sequence
  Description of Artificial Sequence: Synthetic Peptide
  SITE (7)..(7): Xaa is C, E, F, H, I, L, P, T, V, or W
LKASIDXI

SEQ ID NO: 1655 - protein, 8 aa, Artificial Sequence
  Description of Artificial Sequence: Synthetic Peptide
  SITE (7)..(7): Xaa is F, I, M, P, or W
LKASLDXI

SEQ ID NO: 1656 - protein, 8 aa, Artificial Sequence
  Description of Artificial Sequence: Synthetic Peptide
  SITE (7)..(7): Xaa is I  or W
LKASIDXL

SEQ ID NO: 1657 - protein, 8 aa, Artificial Sequence
  Description of Artificial Sequence: Synthetic Peptide
LKASLDPL

SEQ ID NO: 1658 - protein, 8 aa, Artificial Sequence
  Description of Artificial Sequence: Synthetic Peptide
  SITE (7)..(7): Xaa is C, F, H, I, M, P, Q, R, V, or W
LKASIRXI

SEQ ID NO: 1659 - protein, 8 aa, Artificial Sequence
  Description of Artificial Sequence: Synthetic Peptide
  SITE (7)..(7): Xaa is C, F, I, L, P, W, V, or Y
LKASLRXI

SEQ ID NO: 1660 - protein, 8 aa, Artificial Sequence
  Description of Artificial Sequence: Synthetic Peptide
  SITE (7)..(7): Xaa is C, H, I, M Q, E, or W
LKASIRXL

SEQ ID NO: 1661 - protein, 8 aa, Artificial Sequence
  Description of Artificial Sequence: Synthetic Peptide
  SITE (7)..(7): Xaa is C, M, or V
LKASLRXL

SEQ ID NO: 1662 - protein, 8 aa, Artificial Sequence
  Description of Artificial Sequence: Synthetic Peptide
  SITE (7)..(7): Xaa is C, H, I, K, L, N, R, V, W, or Y
LKASISXI

SEQ ID NO: 1663 - protein, 8 aa, Artificial Sequence
  Description of Artificial Sequence: Synthetic Peptide
  SITE (7)..(7): Xaa is C, F, H, M, V, or W
LKASLSXI

SEQ ID NO: 1664 - protein, 8 aa, Artificial Sequence
  Description of Artificial Sequence: Synthetic Peptide
  SITE (7)..(7): Xaa is L or W
LKASISXL

SEQ ID NO: 1665 - protein, 8 aa, Artificial Sequence
  Description of Artificial Sequence: Synthetic Peptide
  SITE (7)..(7): Xaa is M or Y
LKASLSXL

SEQ ID NO: 1666 - protein, 8 aa, Artificial Sequence
  Description of Artificial Sequence: Synthetic Peptide
  SITE (7)..(7): Xaa is C, D, F, H, I, M, P, Q, R, T, W, or Y
LKGDIDXI

SEQ ID NO: 1667 - protein, 8 aa, Artificial Sequence
  Description of Artificial Sequence: Synthetic Peptide
  SITE (7)..(7): Xaa is E, H, M, N, W, or Y
LKGDLDXI

SEQ ID NO: 1668 - protein, 8 aa, Artificial Sequence
  Description of Artificial Sequence: Synthetic Peptide
  SITE (7)..(7): Xaa is C, W, or Y
LKGDIDXL

SEQ ID NO: 1669 - protein, 8 aa, Artificial Sequence
  Description of Artificial Sequence: Synthetic Peptide
  SITE (7)..(7): Xaa is C, F, H, I, N, P, or W
LKGDLDXL

SEQ ID NO: 1670 - protein, 8 aa, Artificial Sequence
  Description of Artificial Sequence: Synthetic Peptide
  SITE (7)..(7): Xaa is A, C, F, H, I, M, Q, S, T, V, W, or Y
LKGDIRXI

SEQ ID NO: 1671 - protein, 8 aa, Artificial Sequence
  Description of Artificial Sequence: Synthetic Peptide
  SITE (7)..(7): Xaa is C, F, I, K, M, Q, V, or W
LKGDLRXI

SEQ ID NO: 1672 - protein, 8 aa, Artificial Sequence
  Description of Artificial Sequence: Synthetic Peptide
  SITE (7)..(7): Xaa is C, G, M, or W
LKGDIRXL

SEQ ID NO: 1673 - protein, 8 aa, Artificial Sequence
  Description of Artificial Sequence: Synthetic Peptide
  SITE (7)..(7): Xaa is C, F, G, W, or Y
LKGDLRXL

SEQ ID NO: 1674 - protein, 8 aa, Artificial Sequence
  Description of Artificial Sequence: Synthetic Peptide
  SITE (7)..(7): Xaa is A, C, H, P, W, or Y
LKGDISXI

SEQ ID NO: 1675 - protein, 8 aa, Artificial Sequence
  Description of Artificial Sequence: Synthetic Peptide
  SITE (7)..(7): Xaa is C, D, E, F, H, P, W, or Y
LKGDLSXI

SEQ ID NO: 1676 - protein, 8 aa, Artificial Sequence
  Description of Artificial Sequence: Synthetic Peptide
  SITE (7)..(7): Xaa is C, M, Q, W, or Y
LKGDISXL

SEQ ID NO: 1677 - protein, 8 aa, Artificial Sequence
  Description of Artificial Sequence: Synthetic Peptide
  SITE (7)..(7): Xaa is C, M, W, or Y
LKGDLSXL

SEQ ID NO: 1678 - protein, 8 aa, Artificial Sequence
  Description of Artificial Sequence: Synthetic Peptide
  SITE (7)..(7): Xaa is C, D, or W
LKGEIDXI

SEQ ID NO: 1679 - protein, 8 aa, Artificial Sequence
  Description of Artificial Sequence: Synthetic Peptide
  SITE (7)..(7): Xaa is C, D, N, W, or Y
LKGELDXI

SEQ ID NO: 1680 - protein, 8 aa, Artificial Sequence
  Description of Artificial Sequence: Synthetic Peptide
LKGEIDWL

SEQ ID NO: 1681 - protein, 8 aa, Artificial Sequence
  Description of Artificial Sequence: Synthetic Peptide
LKGELDWL

SEQ ID NO: 1682 - protein, 8 aa, Artificial Sequence
  Description of Artificial Sequence: Synthetic Peptide
  SITE (7)..(7): Xaa is D, G, H, I, L, M, W, or Y
LKGEIRXI

SEQ ID NO: 1683 - protein, 8 aa, Artificial Sequence
  Description of Artificial Sequence: Synthetic Peptide
  SITE (7)..(7): Xaa is C, H, I, K, M, Q, V, W, or Y
LKGELRXI

SEQ ID NO: 1684 - protein, 8 aa, Artificial Sequence
  Description of Artificial Sequence: Synthetic Peptide
  SITE (7)..(7): Xaa is C, D, H, I, M, N, or W
LKGEIRXL

SEQ ID NO: 1685 - protein, 8 aa, Artificial Sequence
  Description of Artificial Sequence: Synthetic Peptide
  SITE (7)..(7): Xaa is C, H, M, Q, V, or W
LKGELRXL

SEQ ID NO: 1686 - protein, 8 aa, Artificial Sequence
  Description of Artificial Sequence: Synthetic Peptide
  SITE (7)..(7): Xaa is C, M, P, Q, V, W, and Y
LKGEISXI

SEQ ID NO: 1687 - protein, 8 aa, Artificial Sequence
  Description of Artificial Sequence: Synthetic Peptide
  SITE (7)..(7): Xaa is C, F, I, M, P, Q, W, and Y
LKGELSXI

SEQ ID NO: 1688 - protein, 8 aa, Artificial Sequence
  Description of Artificial Sequence: Synthetic Peptide
  SITE (7)..(7): Xaa is C, W, and Y
LKGEISXL

SEQ ID NO: 1689 - protein, 8 aa, Artificial Sequence
  Description of Artificial Sequence: Synthetic Peptide
  SITE (7)..(7): Xaa is C, F, and Y
LKGELSXL

SEQ ID NO: 1690 - protein, 8 aa, Artificial Sequence
  Description of Artificial Sequence: Synthetic Peptide
  SITE (7)..(7): Xaa is C, F, H, L, M, P, Q, V, or W
LKGNIDXI

SEQ ID NO: 1691 - protein, 8 aa, Artificial Sequence
  Description of Artificial Sequence: Synthetic Peptide
  SITE (7)..(7): Xaa is H, M, N, P, R, S, T, V, or Y
LKGNLDXI

SEQ ID NO: 1692 - protein, 8 aa, Artificial Sequence
  Description of Artificial Sequence: Synthetic Peptide
  SITE (7)..(7): Xaa is C, H, R, W, or Y
LKGNIDXL

SEQ ID NO: 1693 - protein, 8 aa, Artificial Sequence
  Description of Artificial Sequence: Synthetic Peptide
  SITE (7)..(7): Xaa is C, H, Q, V, W, or Y
LKGNLDXL

SEQ ID NO: 1694 - protein, 8 aa, Artificial Sequence
  Description of Artificial Sequence: Synthetic Peptide
  SITE (7)..(7): Xaa is C, G, H, I, M, N, P, Q, W, or Y
LKGNIRXI

SEQ ID NO: 1695 - protein, 8 aa, Artificial Sequence
  Description of Artificial Sequence: Synthetic Peptide
  SITE (7)..(7): Xaa is C, E, F, H, L, P, or W
LKGNLRXI

SEQ ID NO: 1696 - protein, 8 aa, Artificial Sequence
  Description of Artificial Sequence: Synthetic Peptide
  SITE (7)..(7): Xaa is A, C, G, K, N, R, S, T, or W
LKGNIRXL

SEQ ID NO: 1697 - protein, 8 aa, Artificial Sequence
  Description of Artificial Sequence: Synthetic Peptide
  SITE (7)..(7): Xaa is C, M, V, W, or Y
LKGNLRXL

SEQ ID NO: 1698 - protein, 8 aa, Artificial Sequence
  Description of Artificial Sequence: Synthetic Peptide
  SITE (7)..(7): Xaa is C, E, H, I, K, M, or N
LKGNISXI

SEQ ID NO: 1699 - protein, 8 aa, Artificial Sequence
  Description of Artificial Sequence: Synthetic Peptide
  SITE (7)..(7): Xaa is C, F, M, N, Q, T, or W
LKGNLSXI

SEQ ID NO: 1700 - protein, 8 aa, Artificial Sequence
  Description of Artificial Sequence: Synthetic Peptide
  SITE (7)..(7): Xaa is C, or W
LKGNISXL

SEQ ID NO: 1701 - protein, 8 aa, Artificial Sequence
  Description of Artificial Sequence: Synthetic Peptide
  SITE (7)..(7): Xaa is C, M, T, W, or Y
LKGNLSXL

SEQ ID NO: 1702 - protein, 8 aa, Artificial Sequence
  Description of Artificial Sequence: Synthetic Peptide
  SITE (7)..(7): Xaa is C, F, I, N, or P
LKGQIDXI

SEQ ID NO: 1703 - protein, 8 aa, Artificial Sequence
  Description of Artificial Sequence: Synthetic Peptide
  SITE (7)..(7): Xaa is D, F, H, Q, V, or W
LKGQLDXI

SEQ ID NO: 1704 - protein, 8 aa, Artificial Sequence
  Description of Artificial Sequence: Synthetic Peptide
  SITE (7)..(7): Xaa is A, C, E, N, or W
LKGQIDXL

SEQ ID NO: 1705 - protein, 8 aa, Artificial Sequence
  Description of Artificial Sequence: Synthetic Peptide
  SITE (7)..(7): Xaa is C, H, W, or Y
LKGQLDXL

SEQ ID NO: 1706 - protein, 8 aa, Artificial Sequence
  Description of Artificial Sequence: Synthetic Peptide
  SITE (7)..(7): Xaa is C, E, F, G, I, L, M, N, P, R, T, V, or Y
LKGQIRXI

SEQ ID NO: 1707 - protein, 8 aa, Artificial Sequence
  Description of Artificial Sequence: Synthetic Peptide
  SITE (7)..(7): Xaa is C, D, E, H, I, P, V, or Y
LKGQLRXI

SEQ ID NO: 1708 - protein, 8 aa, Artificial Sequence
  Description of Artificial Sequence: Synthetic Peptide
  SITE (7)..(7): Xaa is C, D, F, H, I, M, P, R, V, or W
LKGQIRXL

SEQ ID NO: 1709 - protein, 8 aa, Artificial Sequence
  Description of Artificial Sequence: Synthetic Peptide
  SITE (7)..(7): Xaa is C, H, I, M, or W
LKGQLRXL

SEQ ID NO: 1710 - protein, 8 aa, Artificial Sequence
  Description of Artificial Sequence: Synthetic Peptide
  SITE (7)..(7): Xaa is C, H, I, K, M, P, Q, R, W, or Y
LKGQISXI

SEQ ID NO: 1711 - protein, 8 aa, Artificial Sequence
  Description of Artificial Sequence: Synthetic Peptide
  SITE (7)..(7): Xaa is C, D, E, F, M, R, V, or W
LKGQLSXI

SEQ ID NO: 1712 - protein, 8 aa, Artificial Sequence
  Description of Artificial Sequence: Synthetic Peptide
  SITE (7)..(7): Xaa is A, C, H, K, M, N, P, or W
LKGQISXL

SEQ ID NO: 1713 - protein, 8 aa, Artificial Sequence
  Description of Artificial Sequence: Synthetic Peptide
  SITE (7)..(7): Xaa is M, or W
LKGQLSXL

SEQ ID NO: 1714 - protein, 8 aa, Artificial Sequence
  Description of Artificial Sequence: Synthetic Peptide
  SITE (7)..(7): Xaa is C, D, H, M, P, V, W, or Y
LKGSIDXI

SEQ ID NO: 1715 - protein, 8 aa, Artificial Sequence
  Description of Artificial Sequence: Synthetic Peptide
  SITE (7)..(7): Xaa is Q, W, or Y
LKGSLDXI

SEQ ID NO: 1716 - protein, 8 aa, Artificial Sequence
  Description of Artificial Sequence: Synthetic Peptide
  SITE (7)..(7): Xaa is C, H, M, N, or W
LKGSIDXL

SEQ ID NO: 1717 - protein, 8 aa, Artificial Sequence
  Description of Artificial Sequence: Synthetic Peptide
  SITE (7)..(7): Xaa is H, K, P, Q, or V
LKGSLDXL

SEQ ID NO: 1718 - protein, 8 aa, Artificial Sequence
  Description of Artificial Sequence: Synthetic Peptide
  SITE (7)..(7): Xaa is A, E, G, Q, R, T, W, or Y
LKGSIRXI

SEQ ID NO: 1719 - protein, 8 aa, Artificial Sequence
  Description of Artificial Sequence: Synthetic Peptide
  SITE (7)..(7): Xaa is A, C, D, H, I, L, N, Q, R, T, W, or Y
LKGSLRXI

SEQ ID NO: 1720 - protein, 8 aa, Artificial Sequence
  Description of Artificial Sequence: Synthetic Peptide
  SITE (7)..(7): Xaa is E, F, G, H, M, Q, S, V, or W
LKGSIRXL

SEQ ID NO: 1721 - protein, 8 aa, Artificial Sequence
  Description of Artificial Sequence: Synthetic Peptide
LKGSLRCL

SEQ ID NO: 1722 - protein, 8 aa, Artificial Sequence
  Description of Artificial Sequence: Synthetic Peptide
  SITE (7)..(7): Xaa is C, D, H, M, P, V, W, or Y
LKGSISXI

SEQ ID NO: 1723 - protein, 8 aa, Artificial Sequence
  Description of Artificial Sequence: Synthetic Peptide
  SITE (7)..(7): Xaa is C, D, F, H, I, M, or Y
LKGSLSXI

SEQ ID NO: 1724 - protein, 8 aa, Artificial Sequence
  Description of Artificial Sequence: Synthetic Peptide
  SITE (7)..(7): Xaa is A, E, F, G, H, K, M, Q, S, V, or W
LKGSISXL

SEQ ID NO: 1725 - protein, 8 aa, Artificial Sequence
  Description of Artificial Sequence: Synthetic Peptide
  SITE (7)..(7): Xaa is M, P, or R
LKGSLSXL

SEQ ID NO: 1726 - protein, 8 aa, Artificial Sequence
  Description of Artificial Sequence: Synthetic Peptide
  SITE (7)..(7): Xaa is C, E, F, H, I, M, N, P, V, or W
LKLDIDXI

SEQ ID NO: 1727 - protein, 8 aa, Artificial Sequence
  Description of Artificial Sequence: Synthetic Peptide
  SITE (7)..(7): Xaa is C, E, M, N, P, T, V, or W
LKLDLDXI

SEQ ID NO: 1728 - protein, 8 aa, Artificial Sequence
  Description of Artificial Sequence: Synthetic Peptide
  SITE (7)..(7): Xaa is F, Q, V, or W
LKLDIDXL

SEQ ID NO: 1729 - protein, 8 aa, Artificial Sequence
  Description of Artificial Sequence: Synthetic Peptide
  SITE (7)..(7): Xaa is C, M, V, or W
LKLDLDXL

SEQ ID NO: 1730 - protein, 8 aa, Artificial Sequence
  Description of Artificial Sequence: Synthetic Peptide
  SITE (7)..(7): Xaa is C, F, G, H, L, M, P, T, W, or Y
LKLDIRXI

SEQ ID NO: 1731 - protein, 8 aa, Artificial Sequence
  Description of Artificial Sequence: Synthetic Peptide
  SITE (7)..(7): Xaa is F, H, K, R, W, or Y
LKLDLRXI

SEQ ID NO: 1732 - protein, 8 aa, Artificial Sequence
  Description of Artificial Sequence: Synthetic Peptide
  SITE (7)..(7): Xaa is C, D, F, H, K, P, W, or Y
LKLDIRXL

SEQ ID NO: 1733 - protein, 8 aa, Artificial Sequence
  Description of Artificial Sequence: Synthetic Peptide
  SITE (7)..(7): Xaa is C, F, N, R, or W
LKLDLRXL

SEQ ID NO: 1734 - protein, 8 aa, Artificial Sequence
  Description of Artificial Sequence: Synthetic Peptide
  SITE (7)..(7): Xaa is C, E, H, I ,P, S ,v, W, or Y
LKLDISXI

SEQ ID NO: 1735 - protein, 8 aa, Artificial Sequence
  Description of Artificial Sequence: Synthetic Peptide
  SITE (7)..(7): Xaa is I, M, or V
LKLDLSXI

SEQ ID NO: 1736 - protein, 8 aa, Artificial Sequence
  Description of Artificial Sequence: Synthetic Peptide
  SITE (7)..(7): Xaa is C, H, I, L, M, or Y
LKLDISXL

SEQ ID NO: 1737 - protein, 8 aa, Artificial Sequence
  Description of Artificial Sequence: Synthetic Peptide
  SITE (7)..(7): Xaa is C or W
LKLDLSXL

SEQ ID NO: 1738 - protein, 8 aa, Artificial Sequence
  Description of Artificial Sequence: Synthetic Peptide
  SITE (7)..(7): Xaa is C, G, H, Q, T, or W
LKLELDXI

SEQ ID NO: 1739 - protein, 8 aa, Artificial Sequence
  Description of Artificial Sequence: Synthetic Peptide
  SITE (7)..(7): Xaa is C, H, M, P, W, or Y
LKLEIDXL

SEQ ID NO: 1740 - protein, 8 aa, Artificial Sequence
  Description of Artificial Sequence: Synthetic Peptide
  SITE (7)..(7): Xaa is C, M, P ,T or Y
LKLELDXL

SEQ ID NO: 1741 - protein, 8 aa, Artificial Sequence
  Description of Artificial Sequence: Synthetic Peptide
  SITE (7)..(7): Xaa is A, C, H, I, M, N, P, Q, R, V, or W
LKLEIRXI

SEQ ID NO: 1742 - protein, 8 aa, Artificial Sequence
  Description of Artificial Sequence: Synthetic Peptide
  SITE (7)..(7): Xaa is C, D, F ,H, L, M, Q, S, W, or Y
LKLELRXI

SEQ ID NO: 1743 - protein, 8 aa, Artificial Sequence
  Description of Artificial Sequence: Synthetic Peptide
  SITE (7)..(7): Xaa is A, C, F, I, L, M, P, Q, R, S, or W
LKLEIRXL

SEQ ID NO: 1744 - protein, 8 aa, Artificial Sequence
  Description of Artificial Sequence: Synthetic Peptide
  SITE (7)..(7): Xaa is C, F, H, I, M, T, W, or Y
LKLELRXL

SEQ ID NO: 1745 - protein, 8 aa, Artificial Sequence
  Description of Artificial Sequence: Synthetic Peptide
  SITE (7)..(7): Xaa is C, E, G, M, P, S, or T
LKLEISXI

SEQ ID NO: 1746 - protein, 8 aa, Artificial Sequence
  Description of Artificial Sequence: Synthetic Peptide
  SITE (7)..(7): Xaa is C, F, M, Q, R, or V
LKLELSXI

SEQ ID NO: 1747 - protein, 8 aa, Artificial Sequence
  Description of Artificial Sequence: Synthetic Peptide
  SITE (7)..(7): Xaa is A, F, I, T, W, or Y
LKLEISXL

SEQ ID NO: 1748 - protein, 8 aa, Artificial Sequence
  Description of Artificial Sequence: Synthetic Peptide
  SITE (7)..(7): Xaa is C, H, L, or W
LKLELSXL

SEQ ID NO: 1749 - protein, 8 aa, Artificial Sequence
  Description of Artificial Sequence: Synthetic Peptide
  SITE (7)..(7): Xaa is C, F, G, H, M, R, S, or W
LKLNIDXI

SEQ ID NO: 1750 - protein, 8 aa, Artificial Sequence
  Description of Artificial Sequence: Synthetic Peptide
  SITE (7)..(7): Xaa is C, H, I, L, M, P, V, or W
LKLNLDXI

SEQ ID NO: 1751 - protein, 8 aa, Artificial Sequence
  Description of Artificial Sequence: Synthetic Peptide
  SITE (7)..(7): Xaa is C, G, H, I, R, W, or Y
LKLNIDXL

SEQ ID NO: 1752 - protein, 8 aa, Artificial Sequence
  Description of Artificial Sequence: Synthetic Peptide
  SITE (7)..(7): Xaa is C, M, Q, or W
LKLNLDXL

SEQ ID NO: 1753 - protein, 8 aa, Artificial Sequence
  Description of Artificial Sequence: Synthetic Peptide
  SITE (7)..(7): Xaa is C, G, H, K ,L, M, P, W, or Y
LKLNIRXI

SEQ ID NO: 1754 - protein, 8 aa, Artificial Sequence
  Description of Artificial Sequence: Synthetic Peptide
  SITE (7)..(7): Xaa is A, C, F, G, H, K, L, Q, V, W, or Y
LKLNLRXI

SEQ ID NO: 1755 - protein, 8 aa, Artificial Sequence
  Description of Artificial Sequence: Synthetic Peptide
  SITE (7)..(7): Xaa is C, I, M, N, V, W, or Y
LKLNIRXL

SEQ ID NO: 1756 - protein, 8 aa, Artificial Sequence
  Description of Artificial Sequence: Synthetic Peptide
  SITE (7)..(7): Xaa is H, M, R, V, W, or Y
LKLNLRXL

SEQ ID NO: 1757 - protein, 8 aa, Artificial Sequence
  Description of Artificial Sequence: Synthetic Peptide
  SITE (7)..(7): Xaa is A, C, F, I, M, or Y
LKLNISXI

SEQ ID NO: 1758 - protein, 8 aa, Artificial Sequence
  Description of Artificial Sequence: Synthetic Peptide
  SITE (7)..(7): Xaa is A, C, D, I, M, Q, T, V, or W
LKLNLSXI

SEQ ID NO: 1759 - protein, 8 aa, Artificial Sequence
  Description of Artificial Sequence: Synthetic Peptide
  SITE (7)..(7): Xaa is A, C, G, H, K, N, W, or Y
LKLNISXL

SEQ ID NO: 1760 - protein, 8 aa, Artificial Sequence
  Description of Artificial Sequence: Synthetic Peptide
  SITE (7)..(7): Xaa is C, P, or Y
LKLNLSXL

SEQ ID NO: 1761 - protein, 8 aa, Artificial Sequence
  Description of Artificial Sequence: Synthetic Peptide
  SITE (7)..(7): Xaa is C, F, M, P, V, or W
LKLQLDXI

SEQ ID NO: 1762 - protein, 8 aa, Artificial Sequence
  Description of Artificial Sequence: Synthetic Peptide
  SITE (7)..(7): Xaa is A, C, H, M, P, T, V, or W
LKLQIDXL

SEQ ID NO: 1763 - protein, 8 aa, Artificial Sequence
  Description of Artificial Sequence: Synthetic Peptide
  SITE (7)..(7): Xaa is C, F, H, N, or W
LKLQLDXL

SEQ ID NO: 1764 - protein, 8 aa, Artificial Sequence
  Description of Artificial Sequence: Synthetic Peptide
  SITE (7)..(7): Xaa is C, D, E, F, H, I, K, L, M, P, R, S, T, W, or Y
LKLQIRXI

SEQ ID NO: 1765 - protein, 8 aa, Artificial Sequence
  Description of Artificial Sequence: Synthetic Peptide
  SITE (7)..(7): Xaa is C, F, G, H, K, M ,Q, V, W, or Y
LKLQLRXI

SEQ ID NO: 1766 - protein, 8 aa, Artificial Sequence
  Description of Artificial Sequence: Synthetic Peptide
  SITE (7)..(7): Xaa is C, F, G, H, M ,P, T, W, or Y
LKLQIRXL

SEQ ID NO: 1767 - protein, 8 aa, Artificial Sequence
  Description of Artificial Sequence: Synthetic Peptide
  SITE (7)..(7): Xaa is C, F, H ,L, M, N, S, W, or Y
LKLQLRXL

SEQ ID NO: 1768 - protein, 8 aa, Artificial Sequence
  Description of Artificial Sequence: Synthetic Peptide
  SITE (7)..(7): Xaa is A, C, D, E, F, H, L ,P, R, V, W, or Y
LKLQISXI

SEQ ID NO: 1769 - protein, 8 aa, Artificial Sequence
  Description of Artificial Sequence: Synthetic Peptide
  SITE (7)..(7): Xaa is C, G, H, I, M, V, W, or Y
LKLQLSXI

SEQ ID NO: 1770 - protein, 8 aa, Artificial Sequence
  Description of Artificial Sequence: Synthetic Peptide
  SITE (7)..(7): Xaa is A, C, F, H, I, R, T, or V
LKLQISXL

SEQ ID NO: 1771 - protein, 8 aa, Artificial Sequence
  Description of Artificial Sequence: Synthetic Peptide
  SITE (7)..(7): Xaa is C or W
LKLQLSXL

SEQ ID NO: 1772 - protein, 8 aa, Artificial Sequence
  Description of Artificial Sequence: Synthetic Peptide
  SITE (7)..(7): Xaa is C, I, L, M, Q, or W
LKLSIDXI

SEQ ID NO: 1773 - protein, 8 aa, Artificial Sequence
  Description of Artificial Sequence: Synthetic Peptide
  SITE (7)..(7): Xaa is C, H, I, L, M, P, or W
LKLSLDXI

SEQ ID NO: 1774 - protein, 8 aa, Artificial Sequence
  Description of Artificial Sequence: Synthetic Peptide
  SITE (7)..(7): Xaa is F, M, Q, T, or Y
LKLSIDXL

SEQ ID NO: 1775 - protein, 8 aa, Artificial Sequence
  Description of Artificial Sequence: Synthetic Peptide
  SITE (7)..(7): Xaa is C, H, or W
LKLSLDXL

SEQ ID NO: 1776 - protein, 8 aa, Artificial Sequence
  Description of Artificial Sequence: Synthetic Peptide
  SITE (7)..(7): Xaa is A, C, F, H, K, L, N, P, T, V, or Y
LKLSIRXI

SEQ ID NO: 1777 - protein, 8 aa, Artificial Sequence
  Description of Artificial Sequence: Synthetic Peptide
  SITE (7)..(7): Xaa is A, C, F, G, I, K, L, M, P, V, or W
LKLSLRXI

SEQ ID NO: 1778 - protein, 8 aa, Artificial Sequence
  Description of Artificial Sequence: Synthetic Peptide
  SITE (7)..(7): Xaa is A, C, F, G, H, I, M, P, W, or Y
LKLSIRXL

SEQ ID NO: 1779 - protein, 8 aa, Artificial Sequence
  Description of Artificial Sequence: Synthetic Peptide
  SITE (7)..(7): Xaa is R, S, or W
LKLSLRXL

SEQ ID NO: 1780 - protein, 8 aa, Artificial Sequence
  Description of Artificial Sequence: Synthetic Peptide
  SITE (7)..(7): Xaa is A, C, G, H, K, R, W, or Y
LKLSISXI

SEQ ID NO: 1781 - protein, 8 aa, Artificial Sequence
  Description of Artificial Sequence: Synthetic Peptide
  SITE (7)..(7): Xaa is D, F, H, or Y
LKLSLSXI

SEQ ID NO: 1782 - protein, 8 aa, Artificial Sequence
  Description of Artificial Sequence: Synthetic Peptide
  SITE (7)..(7): Xaa is C or M
LKLSISXL

SEQ ID NO: 1783 - protein, 8 aa, Artificial Sequence
  Description of Artificial Sequence: Synthetic Peptide
  SITE (7)..(7): Xaa is F or T
LKLSLSXL

SEQ ID NO: 1784 - protein, 8 aa, Artificial Sequence
  Description of Artificial Sequence: Synthetic Peptide
  SITE (7)..(7): Xaa is C, D, H, M, S, V, or W
LKNDIDXI

SEQ ID NO: 1785 - protein, 8 aa, Artificial Sequence
  Description of Artificial Sequence: Synthetic Peptide
  SITE (7)..(7): Xaa is D, E, F, G, H, M, P, R, V, or W
LKNDLDXI

SEQ ID NO: 1786 - protein, 8 aa, Artificial Sequence
  Description of Artificial Sequence: Synthetic Peptide
  SITE (7)..(7): Xaa is C, F, H, M, R, or W
LKNDIDXL

SEQ ID NO: 1787 - protein, 8 aa, Artificial Sequence
  Description of Artificial Sequence: Synthetic Peptide
  SITE (7)..(7): Xaa is C, G, W, or Y
LKNDLDXL

SEQ ID NO: 1788 - protein, 8 aa, Artificial Sequence
  Description of Artificial Sequence: Synthetic Peptide
  SITE (7)..(7): Xaa is A, C, D, F, M, N, Q, T, W, or Y
LKNDIRXI

SEQ ID NO: 1789 - protein, 8 aa, Artificial Sequence
  Description of Artificial Sequence: Synthetic Peptide
  SITE (7)..(7): Xaa is A, C, D, E, F, G, M, P, Q, T, V, or Y
LKNDLRXI

SEQ ID NO: 1790 - protein, 8 aa, Artificial Sequence
  Description of Artificial Sequence: Synthetic Peptide
  SITE (7)..(7): Xaa is A, I, M, P, Q, T, V, or Y
LKNDIRXL

SEQ ID NO: 1791 - protein, 8 aa, Artificial Sequence
  Description of Artificial Sequence: Synthetic Peptide
  SITE (7)..(7): Xaa is C, D, E ,H, or T
LKNDLRXL

SEQ ID NO: 1792 - protein, 8 aa, Artificial Sequence
  Description of Artificial Sequence: Synthetic Peptide
  SITE (7)..(7): Xaa is A, C, E, F, H, M, P, or Q
LKNDISXI

SEQ ID NO: 1793 - protein, 8 aa, Artificial Sequence
  Description of Artificial Sequence: Synthetic Peptide
  SITE (7)..(7): Xaa is C, F, M, R, V, or W
LKNDLSXI

SEQ ID NO: 1794 - protein, 8 aa, Artificial Sequence
  Description of Artificial Sequence: Synthetic Peptide
  SITE (7)..(7): Xaa is C, I, M, P, Q, R, W, or Y
LKNDISXL

SEQ ID NO: 1795 - protein, 8 aa, Artificial Sequence
  Description of Artificial Sequence: Synthetic Peptide
  SITE (7)..(7): Xaa is C or H
LKNDLSXL

SEQ ID NO: 1796 - protein, 8 aa, Artificial Sequence
  Description of Artificial Sequence: Synthetic Peptide
  SITE (7)..(7): Xaa is M or P
LKNEIDXI

SEQ ID NO: 1797 - protein, 8 aa, Artificial Sequence
  Description of Artificial Sequence: Synthetic Peptide
  SITE (7)..(7): Xaa is A, C, F, G, H, M, or Q
LKNELDXI

SEQ ID NO: 1798 - protein, 8 aa, Artificial Sequence
  Description of Artificial Sequence: Synthetic Peptide
  SITE (7)..(7): Xaa is A, C, M, or P
LKNEIDXL

SEQ ID NO: 1799 - protein, 8 aa, Artificial Sequence
  Description of Artificial Sequence: Synthetic Peptide
  SITE (7)..(7): Xaa is C, F, P, W, or Y
LKNELRXI

SEQ ID NO: 1800 - protein, 8 aa, Artificial Sequence
  Description of Artificial Sequence: Synthetic Peptide
  SITE (7)..(7): Xaa is C, F, M, P, or W
LKNEIRXL

SEQ ID NO: 1801 - protein, 8 aa, Artificial Sequence
  Description of Artificial Sequence: Synthetic Peptide
  SITE (7)..(7): Xaa is C, M, P, Q, W, or Y
LKNELRXL

SEQ ID NO: 1802 - protein, 8 aa, Artificial Sequence
  Description of Artificial Sequence: Synthetic Peptide
  SITE (7)..(7): Xaa is C, H, M, P, or W
LKNEISXI

SEQ ID NO: 1803 - protein, 8 aa, Artificial Sequence
  Description of Artificial Sequence: Synthetic Peptide
  SITE (7)..(7): Xaa is C, I, M, N, W, or Y
LKNELSXI

SEQ ID NO: 1804 - protein, 8 aa, Artificial Sequence
  Description of Artificial Sequence: Synthetic Peptide
  SITE (7)..(7): Xaa is C, M, W, or Y
LKNEISXL

SEQ ID NO: 1805 - protein, 8 aa, Artificial Sequence
  Description of Artificial Sequence: Synthetic Peptide
LKNELSML

SEQ ID NO: 1806 - protein, 8 aa, Artificial Sequence
  Description of Artificial Sequence: Synthetic Peptide
  SITE (7)..(7): Xaa is C, H, M, P, R, C, W, or Y
LKNNIDXI

SEQ ID NO: 1807 - protein, 8 aa, Artificial Sequence
  Description of Artificial Sequence: Synthetic Peptide
  SITE (7)..(7): Xaa is C, G, M, P, Q, or W
LKNNLDXI

SEQ ID NO: 1808 - protein, 8 aa, Artificial Sequence
  Description of Artificial Sequence: Synthetic Peptide
  SITE (7)..(7): Xaa is F, G, M, N, P, Q, or W
LKNNLDXL

SEQ ID NO: 1809 - protein, 8 aa, Artificial Sequence
  Description of Artificial Sequence: Synthetic Peptide
  SITE (7)..(7): Xaa is C, G, H, L, M, N, P, Q, T, or W
LKNNIRXI

SEQ ID NO: 1810 - protein, 8 aa, Artificial Sequence
  Description of Artificial Sequence: Synthetic Peptide
  SITE (7)..(7): Xaa is C, E, H, K, M, N, T, W, or Y
LKNNLRXI

SEQ ID NO: 1811 - protein, 8 aa, Artificial Sequence
  Description of Artificial Sequence: Synthetic Peptide
  SITE (7)..(7): Xaa is C, D, F, G, I, K, M, R, or W
LKNNIRXL

SEQ ID NO: 1812 - protein, 8 aa, Artificial Sequence
  Description of Artificial Sequence: Synthetic Peptide
  SITE (7)..(7): Xaa is C, F, H, K, M, R, W, or Y
LKNNLRXL

SEQ ID NO: 1813 - protein, 8 aa, Artificial Sequence
  Description of Artificial Sequence: Synthetic Peptide
  SITE (7)..(7): Xaa is C, D, H, P Q, S, T, or W
LKNNISXI

SEQ ID NO: 1814 - protein, 8 aa, Artificial Sequence
  Description of Artificial Sequence: Synthetic Peptide
  SITE (7)..(7): Xaa is C, D, H, M, P, or W
LKNNLSXI

SEQ ID NO: 1815 - protein, 8 aa, Artificial Sequence
  Description of Artificial Sequence: Synthetic Peptide
  SITE (7)..(7): Xaa is C, M, or R
LKNNISXL

SEQ ID NO: 1816 - protein, 8 aa, Artificial Sequence
  Description of Artificial Sequence: Synthetic Peptide
  SITE (7)..(7): Xaa is C, H, or W
LKNNLSXL

SEQ ID NO: 1817 - protein, 8 aa, Artificial Sequence
  Description of Artificial Sequence: Synthetic Peptide
  SITE (7)..(7): Xaa is I, M, P, or T
LKNQIDXI

SEQ ID NO: 1818 - protein, 8 aa, Artificial Sequence
  Description of Artificial Sequence: Synthetic Peptide
  SITE (7)..(7): Xaa is C, H, M, P, or V
LKNQIDXL

SEQ ID NO: 1819 - protein, 8 aa, Artificial Sequence
  Description of Artificial Sequence: Synthetic Peptide
  SITE (7)..(7): Xaa is C, F, P, R, or W
LKNQLDXL

SEQ ID NO: 1820 - protein, 8 aa, Artificial Sequence
  Description of Artificial Sequence: Synthetic Peptide
  SITE (7)..(7): Xaa is A, C ,D, F, H, I, L, M, N, P, T, V, W, or Y
LKNQIRXI

SEQ ID NO: 1821 - protein, 8 aa, Artificial Sequence
  Description of Artificial Sequence: Synthetic Peptide
  SITE (7)..(7): Xaa is C, E, F, G, H, R, S, T, W, or Y
LKNQLRXI

SEQ ID NO: 1822 - protein, 8 aa, Artificial Sequence
  Description of Artificial Sequence: Synthetic Peptide
  SITE (7)..(7): Xaa is C, D, F, G, M, P, or W
LKNQIRXL

SEQ ID NO: 1823 - protein, 8 aa, Artificial Sequence
  Description of Artificial Sequence: Synthetic Peptide
  SITE (7)..(7): Xaa is A, C, P, T, V, W, or Y
LKNQLRXL

SEQ ID NO: 1824 - protein, 8 aa, Artificial Sequence
  Description of Artificial Sequence: Synthetic Peptide
  SITE (7)..(7): Xaa is A, C, G, H, M, or S
LKNQISXI

SEQ ID NO: 1825 - protein, 8 aa, Artificial Sequence
  Description of Artificial Sequence: Synthetic Peptide
  SITE (7)..(7): Xaa is C, F, M, P, R, W, or Y
LKNQLSXI

SEQ ID NO: 1826 - protein, 8 aa, Artificial Sequence
  Description of Artificial Sequence: Synthetic Peptide
  SITE (7)..(7): Xaa is C, M, P, or Y
LKNQISXL

SEQ ID NO: 1827 - protein, 8 aa, Artificial Sequence
  Description of Artificial Sequence: Synthetic Peptide
  SITE (7)..(7): Xaa is C, H, P, W, or Y
LKNQLSXL

SEQ ID NO: 1828 - protein, 8 aa, Artificial Sequence
  Description of Artificial Sequence: Synthetic Peptide
  SITE (7)..(7): Xaa is C, H, or Q
LKNSIDXI

SEQ ID NO: 1829 - protein, 8 aa, Artificial Sequence
  Description of Artificial Sequence: Synthetic Peptide
  SITE (7)..(7): Xaa is C, G, H, M, or V
LKNSIDXL

SEQ ID NO: 1830 - protein, 8 aa, Artificial Sequence
  Description of Artificial Sequence: Synthetic Peptide
  SITE (7)..(7): Xaa is C, M, or Q
LKNSLDXL

SEQ ID NO: 1831 - protein, 8 aa, Artificial Sequence
  Description of Artificial Sequence: Synthetic Peptide
  SITE (7)..(7): Xaa is A, E, F, G, H, I, M, P, or W
LKNSIRXI

SEQ ID NO: 1832 - protein, 8 aa, Artificial Sequence
  Description of Artificial Sequence: Synthetic Peptide
  SITE (7)..(7): Xaa is C, I, M, P, or W
LKNSLRXI

SEQ ID NO: 1833 - protein, 8 aa, Artificial Sequence
  Description of Artificial Sequence: Synthetic Peptide
  SITE (7)..(7): Xaa is G, H, K, P, R, W, or Y
LKNSIRXL

SEQ ID NO: 1834 - protein, 8 aa, Artificial Sequence
  Description of Artificial Sequence: Synthetic Peptide
LKNSLRCL

SEQ ID NO: 1835 - protein, 8 aa, Artificial Sequence
  Description of Artificial Sequence: Synthetic Peptide
  misc_feature (7)..(7): Xaa can be any naturally occurring amino acid
LKNSISXI

SEQ ID NO: 1836 - protein, 8 aa, Artificial Sequence
  Description of Artificial Sequence: Synthetic Peptide
  SITE (7)..(7): Xaa is C, M, W, or Y
LKNSLSXI

SEQ ID NO: 1837 - protein, 8 aa, Artificial Sequence
  Description of Artificial Sequence: Synthetic Peptide
  SITE (7)..(7): Xaa is C or H
LKNSLSXL

SEQ ID NO: 1838 - protein, 8 aa, Artificial Sequence
  Description of Artificial Sequence: Synthetic Peptide
  SITE (7)..(7): Xaa is C, H, P, R, T, or W
LKSDIDXI

SEQ ID NO: 1839 - protein, 8 aa, Artificial Sequence
  Description of Artificial Sequence: Synthetic Peptide
  SITE (7)..(7): Xaa is A, D, H, or W
LKSDLDXI

SEQ ID NO: 1840 - protein, 8 aa, Artificial Sequence
  Description of Artificial Sequence: Synthetic Peptide
  SITE (7)..(7): Xaa is C, F, P, Q, or W
LKSDIDXL

SEQ ID NO: 1841 - protein, 8 aa, Artificial Sequence
  Description of Artificial Sequence: Synthetic Peptide
  SITE (7)..(7): Xaa is C, F, P, R, or Y
LKSDLDXL

SEQ ID NO: 1842 - protein, 8 aa, Artificial Sequence
  Description of Artificial Sequence: Synthetic Peptide
  SITE (7)..(7): Xaa is A, F, G, N, P, Q, R, S, V, W, or Y
LKSDIRXI

SEQ ID NO: 1843 - protein, 8 aa, Artificial Sequence
  Description of Artificial Sequence: Synthetic Peptide
  SITE (7)..(7): Xaa is C, D, F, H, I, M, N, Q, or W
LKSDLRXI

SEQ ID NO: 1844 - protein, 8 aa, Artificial Sequence
  Description of Artificial Sequence: Synthetic Peptide
  SITE (7)..(7): Xaa is C, H, L, P, Q, W, or Y
LKSDIRXL

SEQ ID NO: 1845 - protein, 8 aa, Artificial Sequence
  Description of Artificial Sequence: Synthetic Peptide
  SITE (7)..(7): Xaa is L, M, P, or W
LKSDLRXL

SEQ ID NO: 1846 - protein, 8 aa, Artificial Sequence
  Description of Artificial Sequence: Synthetic Peptide
  SITE (7)..(7): Xaa is C, D, H, I, M, P, T, or W
LKSDISXI

SEQ ID NO: 1847 - protein, 8 aa, Artificial Sequence
  Description of Artificial Sequence: Synthetic Peptide
  SITE (7)..(7): Xaa is C, F, I, M, or P
LKSDLSXI

SEQ ID NO: 1848 - protein, 8 aa, Artificial Sequence
  Description of Artificial Sequence: Synthetic Peptide
  SITE (7)..(7): Xaa is C, F, H, M, P, W, or Y
LKSDISXL

SEQ ID NO: 1849 - protein, 8 aa, Artificial Sequence
  Description of Artificial Sequence: Synthetic Peptide
  SITE (7)..(7): Xaa is C, M, or Y
LKSDLSXL

SEQ ID NO: 1850 - protein, 8 aa, Artificial Sequence
  Description of Artificial Sequence: Synthetic Peptide
  SITE (7)..(7): Xaa is C, F, M, V, or W
LKSEIDXI

SEQ ID NO: 1851 - protein, 8 aa, Artificial Sequence
  Description of Artificial Sequence: Synthetic Peptide
  SITE (7)..(7): Xaa is P, T, W, or Y
LKSELDXI

SEQ ID NO: 1852 - protein, 8 aa, Artificial Sequence
  Description of Artificial Sequence: Synthetic Peptide
  SITE (7)..(7): Xaa is C, or W
LKSEIDXL

SEQ ID NO: 1853 - protein, 8 aa, Artificial Sequence
  Description of Artificial Sequence: Synthetic Peptide
LKSELDCL

SEQ ID NO: 1854 - protein, 8 aa, Artificial Sequence
  Description of Artificial Sequence: Synthetic Peptide
  SITE (7)..(7): Xaa is A, C, D, F, H, I, L, M, P, W, or Y
LKSEIRXI

SEQ ID NO: 1855 - protein, 8 aa, Artificial Sequence
  Description of Artificial Sequence: Synthetic Peptide
  SITE (7)..(7): Xaa is A, C, F, I, M, N, V, or W
LKSELRXI

SEQ ID NO: 1856 - protein, 8 aa, Artificial Sequence
  Description of Artificial Sequence: Synthetic Peptide
  SITE (7)..(7): Xaa is F, L, M, P, W, or Y
LKSEIRXL

SEQ ID NO: 1857 - protein, 8 aa, Artificial Sequence
  Description of Artificial Sequence: Synthetic Peptide
  SITE (7)..(7): Xaa is C, H, N, W, or Y
LKSELRXL

SEQ ID NO: 1858 - protein, 8 aa, Artificial Sequence
  Description of Artificial Sequence: Synthetic Peptide
  SITE (7)..(7): Xaa is A, C, F, H, I, L, M, or T
LKSEISXI

SEQ ID NO: 1859 - protein, 8 aa, Artificial Sequence
  Description of Artificial Sequence: Synthetic Peptide
  SITE (7)..(7): Xaa is C, D, M, Q, W, or Y
LKSELSXI

SEQ ID NO: 1860 - protein, 8 aa, Artificial Sequence
  Description of Artificial Sequence: Synthetic Peptide
  SITE (7)..(7): Xaa is C, P, or W
LKSEISXL

SEQ ID NO: 1861 - protein, 8 aa, Artificial Sequence
  Description of Artificial Sequence: Synthetic Peptide
  SITE (7)..(7): Xaa is C, or M
LKSELSXL

SEQ ID NO: 1862 - protein, 8 aa, Artificial Sequence
  Description of Artificial Sequence: Synthetic Peptide
  SITE (7)..(7): Xaa is C, E, G, H, M, P, Q, W, or Y
LKSNIDXI

SEQ ID NO: 1863 - protein, 8 aa, Artificial Sequence
  Description of Artificial Sequence: Synthetic Peptide
  SITE (7)..(7): Xaa is F, G, H, Q, T, or W
LKSNLDXI

SEQ ID NO: 1864 - protein, 8 aa, Artificial Sequence
  Description of Artificial Sequence: Synthetic Peptide
  SITE (7)..(7): Xaa is C, I, P, Q, R, or W
LKSNIDXL

SEQ ID NO: 1865 - protein, 8 aa, Artificial Sequence
  Description of Artificial Sequence: Synthetic Peptide
  SITE (7)..(7): Xaa is H, I, or W
LKSNLDXL

SEQ ID NO: 1866 - protein, 8 aa, Artificial Sequence
  Description of Artificial Sequence: Synthetic Peptide
  SITE (7)..(7): Xaa is C, H, P, T, or Y
LKSNISXI

SEQ ID NO: 1867 - protein, 8 aa, Artificial Sequence
  Description of Artificial Sequence: Synthetic Peptide
  SITE (7)..(7): Xaa is H, or Q
LKSNLSXI

SEQ ID NO: 1868 - protein, 8 aa, Artificial Sequence
  Description of Artificial Sequence: Synthetic Peptide
  SITE (7)..(7): Xaa is C, E, F, H, L, M, N, T, V, or W
LKSNISXL

SEQ ID NO: 1869 - protein, 8 aa, Artificial Sequence
  Description of Artificial Sequence: Synthetic Peptide
  SITE (7)..(7): Xaa is C, or G
LKSNLSXL

SEQ ID NO: 1870 - protein, 8 aa, Artificial Sequence
  Description of Artificial Sequence: Synthetic Peptide
  SITE (7)..(7): Xaa is C, F, G, H, I, M, P, or V
LKSQIDXI

SEQ ID NO: 1871 - protein, 8 aa, Artificial Sequence
  Description of Artificial Sequence: Synthetic Peptide
  SITE (7)..(7): Xaa is C, P, V, or Y
LKSQLDXI

SEQ ID NO: 1872 - protein, 8 aa, Artificial Sequence
  Description of Artificial Sequence: Synthetic Peptide
  SITE (7)..(7): Xaa is C, I, P, or W
LKSQIDXL

SEQ ID NO: 1873 - protein, 8 aa, Artificial Sequence
  Description of Artificial Sequence: Synthetic Peptide
  SITE (7)..(7): Xaa is C, F, M, P, W, or Y
LKSQLDXL

SEQ ID NO: 1874 - protein, 8 aa, Artificial Sequence
  Description of Artificial Sequence: Synthetic Peptide
  SITE (7)..(7): Xaa is C, H, L, M, N, Q, T, W, or Y
LKSQIRXI

SEQ ID NO: 1875 - protein, 8 aa, Artificial Sequence
  Description of Artificial Sequence: Synthetic Peptide
  SITE (7)..(7): Xaa is F, I, M, S, W, or Y
LKSQLRXI

SEQ ID NO: 1876 - protein, 8 aa, Artificial Sequence
  Description of Artificial Sequence: Synthetic Peptide
  SITE (7)..(7): Xaa is C, G, H, M, W, or Y
LKSQIRXL

SEQ ID NO: 1877 - protein, 8 aa, Artificial Sequence
  Description of Artificial Sequence: Synthetic Peptide
  SITE (7)..(7): Xaa is C, F, H, M, P, V, or W
LKSQLRXL

SEQ ID NO: 1878 - protein, 8 aa, Artificial Sequence
  Description of Artificial Sequence: Synthetic Peptide
  SITE (7)..(7): Xaa is C, H, I, M, W, or Y
LKSQISXI

SEQ ID NO: 1879 - protein, 8 aa, Artificial Sequence
  Description of Artificial Sequence: Synthetic Peptide
  SITE (7)..(7): Xaa is C, G, I, M, P, T, or W
LKSQLSXI

SEQ ID NO: 1880 - protein, 8 aa, Artificial Sequence
  Description of Artificial Sequence: Synthetic Peptide
  SITE (7)..(7): Xaa is C, H, M, or W
LKSQISXL

SEQ ID NO: 1881 - protein, 8 aa, Artificial Sequence
  Description of Artificial Sequence: Synthetic Peptide
  SITE (7)..(7): Xaa is C, H, I, M, W, or Y
LKSQLSXL

SEQ ID NO: 1882 - protein, 8 aa, Artificial Sequence
  Description of Artificial Sequence: Synthetic Peptide
  SITE (7)..(7): Xaa is C, F, H, or R
LKSSIDXI

SEQ ID NO: 1883 - protein, 8 aa, Artificial Sequence
  Description of Artificial Sequence: Synthetic Peptide
  SITE (7)..(7): Xaa is C, F, P, V, or Y
LKSSLDXI

SEQ ID NO: 1884 - protein, 8 aa, Artificial Sequence
  Description of Artificial Sequence: Synthetic Peptide
  SITE (7)..(7): Xaa is C, F, or W
LKSSIDXL

SEQ ID NO: 1885 - protein, 8 aa, Artificial Sequence
  Description of Artificial Sequence: Synthetic Peptide
  SITE (7)..(7): Xaa is C, M, or Y
LKSSLDXL

SEQ ID NO: 1886 - protein, 8 aa, Artificial Sequence
  Description of Artificial Sequence: Synthetic Peptide
  SITE (7)..(7): Xaa is C, E, G, H, I, M, N, P, R, W, or Y
LKSSIRXI

SEQ ID NO: 1887 - protein, 8 aa, Artificial Sequence
  Description of Artificial Sequence: Synthetic Peptide
  SITE (7)..(7): Xaa is A, C, K, L, M, P, V, or Y
LKSSLRXI

SEQ ID NO: 1888 - protein, 8 aa, Artificial Sequence
  Description of Artificial Sequence: Synthetic Peptide
  SITE (7)..(7): Xaa is I, M, P, or W
LKSSIRXL

SEQ ID NO: 1889 - protein, 8 aa, Artificial Sequence
  Description of Artificial Sequence: Synthetic Peptide
  SITE (7)..(7): Xaa is C, H, or Y
LKSSLRXL

SEQ ID NO: 1890 - protein, 8 aa, Artificial Sequence
  Description of Artificial Sequence: Synthetic Peptide
  SITE (7)..(7): Xaa is A, C, F, M, W, or Y
LKSSISXI

SEQ ID NO: 1891 - protein, 8 aa, Artificial Sequence
  Description of Artificial Sequence: Synthetic Peptide
  SITE (7)..(7): Xaa is C, M, W, or Y
LKSSLSXI

SEQ ID NO: 1892 - protein, 8 aa, Artificial Sequence
  Description of Artificial Sequence: Synthetic Peptide
  SITE (7)..(7): Xaa is M, or W
LKSSISXL

SEQ ID NO: 1893 - protein, 8 aa, Artificial Sequence
  Description of Artificial Sequence: Synthetic Peptide
  SITE (7)..(7): Xaa is C, or W
LKSSLSXL

SEQ ID NO: 1894 - protein, 8 aa, Artificial Sequence
  Description of Artificial Sequence: Synthetic Peptide
FKGQLRAI

SEQ ID NO: 1895 - protein, 8 aa, Artificial Sequence
  Description of Artificial Sequence: Synthetic Peptide
FKGQLRDI

SEQ ID NO: 1896 - protein, 8 aa, Artificial Sequence
  Description of Artificial Sequence: Synthetic Peptide
FKGQLRFI

SEQ ID NO: 1897 - protein, 8 aa, Artificial Sequence
  Description of Artificial Sequence: Synthetic Peptide
FKGQLRII

SEQ ID NO: 1898 - protein, 8 aa, Artificial Sequence
  Description of Artificial Sequence: Synthetic Peptide
FKGQLRKI

SEQ ID NO: 1899 - protein, 8 aa, Artificial Sequence
  Description of Artificial Sequence: Synthetic Peptide
FKGQLRMI

SEQ ID NO: 1900 - protein, 8 aa, Artificial Sequence
  Description of Artificial Sequence: Synthetic Peptide
FKGQLRNI

SEQ ID NO: 1901 - protein, 8 aa, Artificial Sequence
  Description of Artificial Sequence: Synthetic Peptide
FKGQLRPI

SEQ ID NO: 1902 - protein, 8 aa, Artificial Sequence
  Description of Artificial Sequence: Synthetic Peptide
FKGQLRQI

SEQ ID NO: 1903 - protein, 8 aa, Artificial Sequence
  Description of Artificial Sequence: Synthetic Peptide
FKGQLRRI

SEQ ID NO: 1904 - protein, 8 aa, Artificial Sequence
  Description of Artificial Sequence: Synthetic Peptide
FKGQLRSI

SEQ ID NO: 1905 - protein, 8 aa, Artificial Sequence
  Description of Artificial Sequence: Synthetic Peptide
FKGQLRTI

SEQ ID NO: 1906 - protein, 8 aa, Artificial Sequence
  Description of Artificial Sequence: Synthetic Peptide
FKGQLRWI

SEQ ID NO: 1907 - protein, 8 aa, Artificial Sequence
  Description of Artificial Sequence: Synthetic Peptide
FKGQLRYI

SEQ ID NO: 1908 - protein, 8 aa, Artificial Sequence
  Description of Artificial Sequence: Synthetic Peptide
LKGQLRCI

SEQ ID NO: 1909 - protein, 8 aa, Artificial Sequence
  Description of Artificial Sequence: Synthetic Peptide
LGGFLRCI

SEQ ID NO: 1910 - protein, 8 aa, Artificial Sequence
  Description of Artificial Sequence: Synthetic Peptide
LKLKLRQI

SEQ ID NO: 1911 - protein, 8 aa, Artificial Sequence
  Description of Artificial Sequence: Synthetic Peptide
  SITE (7)..(7): Xaa is A, D, F, I, K, M, N, P, Q, R, S, T, W, or Y
FKGQLRXI

What is claimed is:

1. An isolated or purified compound having anti-cell proliferative activity, wherein the compound consists of an 8 to about 45 amino acid residue sequence and wherein the 8 to about 45 amino acid residue sequence includes the sequence F-K-G-Q-L-R-X-I (SEQ ID NO: 1911), wherein X is A, F, I, K, M, N, P, R, T, W, or Y.

2. The compound of claim 1, wherein the compound has less than about 25 amino acid residues.

3. The compound of claim 1, wherein the compound has less than about 20 amino acid residues.

4. The compound of claim 1, wherein the compound has between about 10 and 25 amino acid residues.

5. The compound of claim 1, wherein the compound has between about 10 and 20 amino acid residues.

6. The compound of claim 1, wherein the compound has between about 10 and 16 amino acid residues.

7. The compound of claim 1, wherein the compound comprises one or more L-amino acids, one or more D-amino acids, or one or more non-naturally occurring amino acids.

8. The compound of claim 1, wherein the compound has activity against a metastatic or non-metastatic cancer, tumor or neoplastic cell.

9. The compound of claim 1, wherein the compound is purified.

10. The compound of claim 1, further comprising a pharmaceutically acceptable carrier or excipient.

11. The compound of claim 1, wherein the compound consists of an 8 to about 30 amino acid residue sequence.

12. An isolated or purified compound having anti-cell proliferative activity, wherein the compound consists of an 8 to about 45 amino acid residue sequence which includes within the sequence an 8 reside sequences selected from: L-K-G-Q-L-R-C-I (SEQ ID NO: 1908), or L-G-G-F-L-R-C-I (SEQ ID NO: 1909).

* * * * *